US012807947B2

(12) United States Patent
Mcininch et al.

(10) Patent No.: US 12,807,947 B2
(45) Date of Patent: Nov. 24, 2026

(54) IRNA COMPOSITIONS AND METHODS FOR SILENCING GROWTH FACTOR RECEPTOR BOUND PROTEIN 10 (GRB10) OR GROWTH FACTOR RECEPTOR BOUND PROTEIN 14 (GRB14) IN THE LIVER

(71) Applicant: ALNYLAM PHARMACEUTICALS, INC., Cambridge, MA (US)

(72) Inventors: James D. Mcininch, Burlington, MA (US); Aimee Deaton, Somerville, MA (US); Lucas Bondurant, Brookline, MA (US); Mark K. Schlegel, Lexington, MA (US); Adam Castoreno, Framingham, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 781 days.

(21) Appl. No.: 18/044,401

(22) PCT Filed: Sep. 9, 2021

(86) PCT No.: PCT/US2021/049663

§ 371 (c)(1),
(2) Date: Mar. 8, 2023

(87) PCT Pub. No.: WO2022/056127

PCT Pub. Date: Mar. 17, 2022

(65) Prior Publication Data

US 2023/0332147 A1 Oct. 19, 2023

Related U.S. Application Data

(60) Provisional application No. 63/076,281, filed on Sep. 9, 2020.

(51) Int. Cl.
*C12N 15/113* (2010.01)

(52) U.S. Cl.
CPC ........ *C12N 15/113* (2013.01); *C12N 2310/14* (2013.01); *C12N 2310/315* (2013.01); *C12N 2310/321* (2013.01); *C12N 2310/322* (2013.01); *C12N 2310/351* (2013.01); *C12N 2310/3515* (2013.01)

(58) Field of Classification Search
None
See application file for complete search history.

(56) References Cited

U.S. PATENT DOCUMENTS

| | | | |
|---|---|---|---|
| 3,687,808 | A | 8/1972 | Merigan, Jr. et al. |
| 4,426,330 | A | 1/1984 | Sears |
| 4,469,863 | A | 9/1984 | Ts'o et al. |
| 4,476,301 | A | 10/1984 | Imbach et al. |
| 4,534,899 | A | 8/1985 | Sears |
| 4,587,044 | A | 5/1986 | Miller et al. |
| 4,605,735 | A | 8/1986 | Miyoshi et al. |
| 4,667,025 | A | 5/1987 | Miyoshi et al. |
| 4,762,779 | A | 8/1988 | Snitman |
| 4,789,737 | A | 12/1988 | Miyoshi et al. |
| 4,824,941 | A | 4/1989 | Gordon et al. |
| 4,828,979 | A | 5/1989 | Klevan et al. |
| 4,835,263 | A | 5/1989 | Nguyen et al. |
| 4,837,028 | A | 6/1989 | Allen |
| 4,845,205 | A | 7/1989 | Huynh Dinh et al. |
| 4,876,335 | A | 10/1989 | Yamane et al. |
| 4,904,582 | A | 2/1990 | Tullis |
| 4,948,882 | A | 8/1990 | Ruth |
| 4,958,013 | A | 9/1990 | Letsinger |
| 4,981,957 | A | 1/1991 | Lebleu et al. |
| 5,013,556 | A | 5/1991 | Woodle et al. |
| 5,023,243 | A | 6/1991 | Tullis |
| 5,032,401 | A | 7/1991 | Jamas et al. |
| 5,034,506 | A | 7/1991 | Summerton et al. |
| 5,082,830 | A | 1/1992 | Brakel et al. |
| 5,109,124 | A | 4/1992 | Ramachandran et al. |
| 5,112,963 | A | 5/1992 | Pieles et al. |
| 5,118,800 | A | 6/1992 | Smith et al. |
| 5,118,802 | A | 6/1992 | Smith et al. |
| 5,130,302 | A | 7/1992 | Spielvogel et al. |
| 5,134,066 | A | 7/1992 | Rogers et al. |
| 5,138,045 | A | 8/1992 | Cook et al. |
| 5,139,941 | A | 8/1992 | Muzyczka et al. |
| 5,166,315 | A | 11/1992 | Summerton et al. |
| 5,175,273 | A | 12/1992 | Bischofberger et al. |
| 5,177,195 | A | 1/1993 | Gregory et al. |
| 5,185,444 | A | 2/1993 | Summerton et al. |
| 5,188,897 | A | 2/1993 | Suhadolnik et al. |
| 5,213,804 | A | 5/1993 | Martin et al. |
| 5,214,134 | A | 5/1993 | Weis et al. |
| 5,214,136 | A | 5/1993 | Lin et al. |
| 5,216,141 | A | 6/1993 | Benner |
| 5,218,105 | A | 6/1993 | Cook et al. |
| 5,225,212 | A | 7/1993 | Martin et al. |
| 5,235,033 | A | 8/1993 | Summerton et al. |

(Continued)

FOREIGN PATENT DOCUMENTS

| | | |
|---|---|---|
| EP | 0445131 | 4/1994 |
| EP | 0496813 | 12/1994 |

(Continued)

OTHER PUBLICATIONS

NCBI GRB14 (1998. *Homo sapiens* Grb14 mRNA, complete cds, GenBank: L76687.1) (Year: 1998).*

(Continued)

*Primary Examiner* — Nancy J Leith
*Assistant Examiner* — Ruth Sophia Arieti
(74) *Attorney, Agent, or Firm* — Womble Bond Dickinson (US) LLP

(57) ABSTRACT

The invention relates to double-stranded ribonucleic acid (dsRNA) compositions targeting the GRB10 or GRB14 gene, as well as methods of inhibiting expression of GRB10 or GRB14, and methods of treating subjects that would benefit from reduction in expression of GRB10 or GRB14, such as subjects having a GRB10- or GRB14-associated disease, disorder, or condition, such as diabetes, using such dsRNA compositions.

18 Claims, No Drawings

Specification includes a Sequence Listing.

(56) References Cited

U.S. PATENT DOCUMENTS 5,245,022 A 9/1993 Weis et al.
5,252,479 A 10/1993 Srivastava
5,254,469 A 10/1993 Warren, III et al.
5,258,506 A 11/1993 Urdea et al.
5,262,536 A 11/1993 Hobbs, Jr.
5,264,221 A 11/1993 Tagawa et al.
5,264,423 A 11/1993 Cohen et al.
5,264,562 A 11/1993 Matteucci
5,264,564 A 11/1993 Matteucci
5,272,250 A 12/1993 Spielvogel et al.
5,276,019 A 1/1994 Cohen et al.
5,278,302 A 1/1994 Caruthers et al.
5,286,717 A 2/1994 Cohen et al.
5,292,873 A 3/1994 Rokita et al.
5,317,098 A 5/1994 Shizuya et al.
5,319,080 A 6/1994 Leumann
5,321,131 A 6/1994 Agrawal et al.
5,356,633 A 10/1994 Woodle et al.
5,359,044 A 10/1994 Cook et al.
5,367,066 A 11/1994 Urdea et al.
5,371,241 A 12/1994 Brush
5,391,723 A 2/1995 Priest
5,393,878 A 2/1995 Leumann
5,399,676 A 3/1995 Froehler
5,405,938 A 4/1995 Summerton et al.
5,405,939 A 4/1995 Suhadolnik et al.
5,414,077 A 5/1995 Lin et al.
5,416,203 A 5/1995 Letsinger
5,432,272 A 7/1995 Benner
5,434,257 A 7/1995 Matteucci et al.
5,436,146 A 7/1995 Shenk et al.
5,446,137 A 8/1995 Maag et al.
5,451,463 A 9/1995 Nelson et al.
5,453,496 A 9/1995 Caruthers et al.
5,455,233 A 10/1995 Spielvogel et al.
5,457,187 A 10/1995 Gmeiner et al.
5,459,255 A 10/1995 Cook et al.
5,466,677 A 11/1995 Baxter et al.
5,466,786 A 11/1995 Buhr et al.
5,470,967 A 11/1995 Huie et al.
5,476,925 A 12/1995 Letsinger et al.
5,484,908 A 1/1996 Froehler et al.
5,486,603 A 1/1996 Buhr
5,489,677 A 2/1996 Sanghvi et al.
5,502,177 A 3/1996 Matteucci et al.
5,510,475 A 4/1996 Agrawal et al.
5,512,439 A 4/1996 Hornes et al.
5,512,667 A 4/1996 Reed et al.
5,514,785 A 5/1996 Van Ness et al.
5,519,126 A 5/1996 Hecht
5,519,134 A 5/1996 Acevedo et al.
5,525,465 A 6/1996 Haralambidis et al.
5,525,711 A 6/1996 Hawkins et al.
5,536,821 A 7/1996 Agrawal et al.
5,539,082 A 7/1996 Nielsen et al.
5,540,935 A 7/1996 Miyazaki et al.
5,541,307 A 7/1996 Cook et al.
5,541,313 A 7/1996 Ruth
5,541,316 A 7/1996 Engelskirchen et al.
5,543,152 A 8/1996 Webb et al.
5,545,730 A 8/1996 Urdea et al.
5,550,111 A 8/1996 Suhadolnik et al.
5,552,538 A 9/1996 Urdea et al.
5,552,540 A 9/1996 Haralambidis
5,556,948 A 9/1996 Tagawa et al.
5,561,225 A 10/1996 Maddry et al.
5,563,253 A 10/1996 Agrawal et al.
5,565,552 A 10/1996 Magda et al.
5,567,810 A 10/1996 Weis et al.
5,567,811 A 10/1996 Misiura et al.
5,571,799 A 11/1996 Tkachuk et al.
5,574,142 A 11/1996 Meyer, Jr. et al.
5,576,427 A 11/1996 Cook et al.
5,578,717 A 11/1996 Urdea et al.
5,578,718 A 11/1996 Cook et al.
5,580,731 A 12/1996 Chang et al.
5,585,481 A 12/1996 Arnold, Jr. et al.
5,587,361 A 12/1996 Cook et al.
5,587,371 A 12/1996 Sessler et al.
5,587,469 A 12/1996 Cook et al.
5,591,584 A 1/1997 Chang et al.
5,591,722 A 1/1997 Montgomery et al.
5,594,121 A 1/1997 Froehler et al.
5,595,726 A 1/1997 Magda et al.
5,596,086 A 1/1997 Matteucci et al.
5,596,091 A 1/1997 Switzer
5,597,696 A 1/1997 Linn et al.
5,597,909 A 1/1997 Urdea et al.
5,599,923 A 2/1997 Sessler et al.
5,599,928 A 2/1997 Hemmi et al.
5,602,240 A 2/1997 De Mesmaeker et al.
5,607,677 A 3/1997 Jamas et al.
5,608,046 A 3/1997 Cook et al.
5,610,289 A 3/1997 Cook et al.
5,610,300 A 3/1997 Altmann et al.
5,614,617 A 3/1997 Cook et al.
5,618,704 A 4/1997 Sanghvi et al.
5,623,070 A 4/1997 Cook et al.
5,625,050 A 4/1997 Beaton et al.
5,627,053 A 5/1997 Usman et al.
5,633,360 A 5/1997 Bischofberger et al.
5,639,873 A 6/1997 Barascut et al.
5,646,265 A 7/1997 McGee
5,658,873 A 8/1997 Bertsch-Frank et al.
5,663,312 A 9/1997 Chaturvedula
5,665,557 A 9/1997 Murray et al.
5,665,710 A 9/1997 Rahman et al.
5,670,633 A 9/1997 Cook et al.
5,677,437 A 10/1997 Teng et al.
5,677,439 A 10/1997 Weis et al.
5,681,941 A 10/1997 Cook et al.
5,688,941 A 11/1997 Cook et al.
5,700,920 A 12/1997 Altmann et al.
5,705,188 A 1/1998 Junichi et al.
5,714,331 A 2/1998 Buchardt et al.
5,719,262 A 2/1998 Buchardt et al.
5,750,692 A 5/1998 Cook et al.
5,976,567 A 11/1999 Wheeler et al.
5,981,276 A 11/1999 Sodroski et al.
5,981,501 A 11/1999 Wheeler et al.
6,015,886 A 1/2000 Dale et al.
6,028,188 A 2/2000 Arnold, Jr. et al.
6,054,299 A 4/2000 Conrad
6,124,445 A 9/2000 Imbach et al.
6,143,520 A 11/2000 Marasco et al.
6,147,200 A 11/2000 Manoharan et al.
6,160,109 A 12/2000 Just et al.
6,166,197 A 12/2000 Cook et al.
6,169,170 B1 1/2001 Gryaznov et al.
6,172,209 B1 1/2001 Manoharan et al.
6,191,105 B1 2/2001 Ekwuribe et al.
6,222,025 B1 4/2001 Cook et al.
6,235,887 B1 5/2001 Froehler et al.
6,239,265 B1 5/2001 Cook
6,268,490 B1 7/2001 Imanishi et al.
6,277,603 B1 8/2001 Cook
6,294,664 B1 9/2001 Ravikumar et al.
6,320,017 B1 11/2001 Ansell
6,326,199 B1 12/2001 Cook et al.
6,346,614 B1 2/2002 Metelev et al.
6,380,368 B1 4/2002 Froehler et al.
6,444,423 B1 9/2002 Meade et al.
6,525,191 B1 2/2003 Ramasamy
6,528,640 B1 3/2003 Beigelman et al.
6,531,590 B1 3/2003 Manoharan et al.
6,534,484 B1 3/2003 Wheeler et al.
6,534,639 B1 3/2003 Manoharan et al.
6,576,752 B1 6/2003 Manoharan et al.
6,586,410 B1 7/2003 Wheeler et al.
6,608,035 B1 8/2003 Agrawal et al.
6,617,438 B1 9/2003 Beigelman et al.
6,639,062 B2 10/2003 Manoharan et al.
6,670,461 B1 12/2003 Wengel et al.
6,683,167 B2 1/2004 Metelev et al.

(56) References Cited

U.S. PATENT DOCUMENTS

| | | | |
|---|---|---|---|
| 6,747,014 B2 | 6/2004 | Teng et al. | |
| 6,770,748 B2 | 8/2004 | Imanishi et al. | |
| 6,783,931 B1 | 8/2004 | Cook et al. | |
| 6,794,499 B2 | 9/2004 | Wengel et al. | |
| 6,815,432 B2 | 11/2004 | Wheeler et al. | |
| 6,858,225 B2 | 2/2005 | Semple et al. | |
| 6,858,715 B2 | 2/2005 | Ravikumar et al. | |
| 6,867,294 B1 | 3/2005 | Sanghvi et al. | |
| 6,878,805 B2 | 4/2005 | Manoharan et al. | |
| 6,887,906 B1 | 5/2005 | Teng et al. | |
| 6,900,297 B1 | 5/2005 | Cook et al. | |
| 6,998,484 B2 | 2/2006 | Koch et al. | |
| 7,015,315 B1 | 3/2006 | Cook et al. | |
| 7,034,133 B2 | 4/2006 | Wengel et al. | |
| 7,037,646 B1 | 5/2006 | Cook et al. | |
| 7,041,816 B2 | 5/2006 | Ravikumar et al. | |
| 7,045,610 B2 | 5/2006 | Dempcy et al. | |
| 7,053,207 B2 | 5/2006 | Wengel | |
| 7,063,860 B2 | 6/2006 | Chancellor et al. | |
| 7,070,802 B1 | 7/2006 | Bhalani et al. | |
| 7,084,125 B2 | 8/2006 | Wengel | |
| RE39,464 E | 1/2007 | Cook et al. | |
| 7,157,099 B2 | 1/2007 | Autuori et al. | |
| 7,273,933 B1 | 9/2007 | Krotz et al. | |
| 7,321,029 B2 | 1/2008 | Gryaznov et al. | |
| 7,399,845 B2 | 7/2008 | Seth et al. | |
| 7,427,605 B2 | 9/2008 | Davis et al. | |
| 7,427,672 B2 | 9/2008 | Imanishi et al. | |
| 7,495,088 B1 | 2/2009 | Brakel et al. | |
| 7,569,686 B1 | 8/2009 | Bhat et al. | |
| 7,741,457 B2 | 6/2010 | Seth et al. | |
| 7,858,769 B2 | 12/2010 | Jadhav et al. | |
| 8,022,193 B2 | 9/2011 | Seth et al. | |
| 8,030,467 B2 | 10/2011 | Seth et al. | |
| 8,058,069 B2 | 11/2011 | Yaworski et al. | |
| 8,101,348 B2 | 1/2012 | Tuschl et al. | |
| 8,106,022 B2 | 1/2012 | Manoharan et al. | |
| 8,158,601 B2 | 4/2012 | Chen et al. | |
| 8,278,283 B2 | 10/2012 | Seth et al. | |
| 8,278,425 B2 | 10/2012 | Prakash et al. | |
| 8,278,426 B2 | 10/2012 | Seth et al. | |
| 8,314,227 B2 | 11/2012 | Wengel | |
| 8,883,202 B2 | 11/2014 | Manoharan et al. | |
| 2003/0027780 A1 | 2/2003 | Hardee et al. | |
| 2004/0171570 A1 | 9/2004 | Allerson et al. | |
| 2005/0226848 A1 | 10/2005 | Kuwabara et al. | |
| 2005/0281781 A1 | 12/2005 | Ostroff | |
| 2006/0148743 A1* | 7/2006 | Jadhav | C12N 15/1137 536/23.1 |
| 2006/0199226 A1 | 9/2006 | Schiffer | |
| 2006/0240093 A1 | 10/2006 | MacLachlan et al. | |
| 2006/0257851 A1 | 11/2006 | Bentwich | |
| 2007/0111963 A1 | 5/2007 | Corey et al. | |
| 2007/0135372 A1 | 6/2007 | MacLachlan et al. | |
| 2008/0039618 A1 | 2/2008 | Allerson et al. | |
| 2009/0012281 A1 | 1/2009 | Swayze et al. | |
| 2009/0023673 A1 | 1/2009 | Manoharan et al. | |
| 2011/0313020 A1 | 12/2011 | Templin et al. | |
| 2012/0101148 A1 | 4/2012 | Aking et al. | |
| 2012/0157511 A1 | 6/2012 | Manoharan et al. | |
| 2013/0011922 A1 | 1/2013 | Quay et al. | |
| 2013/0096289 A1 | 4/2013 | Wengel | |
| 2013/0190383 A1 | 7/2013 | Vaish et al. | |
| 2016/0244763 A1 | 8/2016 | Fitzgerald et al. | |
| 2022/0119890 A1 | 4/2022 | Venn et al. | |
| 2023/0332147 A1 | 10/2023 | Mcininch et al. | |

FOREIGN PATENT DOCUMENTS

| | | | |
|---|---|---|---|
| WO | WO 1988/04924 | 7/1988 | |
| WO | WO 1990/04384 | 5/1990 | |
| WO | WO 1991/05545 | 5/1991 | |
| WO | WO 1993/24641 | 12/1993 | |
| WO | WO 1994/02595 | 2/1994 | |
| WO | WO 1994/12649 | 6/1994 | |
| WO | WO 1994/13788 | 6/1994 | |
| WO | WO 1994/20073 | 9/1994 | |
| WO | WO 1996/10391 | 4/1996 | |
| WO | WO 1996/40062 | 12/1996 | |
| WO | WO 1996/40964 | 12/1996 | |
| WO | WO 1997/04787 | 2/1997 | |
| WO | WO 1997/13499 | 4/1997 | |
| WO | WO 1997/30731 | 8/1997 | |
| WO | WO 1999/14226 | 3/1999 | |
| WO | WO 2000/22114 | 4/2000 | |
| WO | WO 2000/66604 | 11/2000 | |
| WO | WO 2007/091269 | 8/2007 | |
| WO | WO 2007/117686 | 10/2007 | |
| WO | WO 2008/042973 | 4/2008 | |
| WO | WO 2009/014887 | 1/2009 | |
| WO | WO 2009/082817 | 7/2009 | |
| WO | WO 2009/127060 | 10/2009 | |
| WO | WO 2010/011895 | 1/2010 | |
| WO | WO 2010/048536 | 4/2010 | |
| WO | WO 2010/054406 | 5/2010 | |
| WO | WO 2010/088537 | 8/2010 | |
| WO | WO 2010/129709 | 11/2010 | |
| WO | WO 2010/141511 | 12/2010 | |
| WO | WO 2010/144740 | 12/2010 | |
| WO | WO 2011/005861 | 1/2011 | |
| WO | WO 2011/031520 | 3/2011 | |
| WO | WO 2011/133876 | 10/2011 | |
| WO | WO 2013/036868 | 3/2013 | |
| WO | WO 2013/075035 | 5/2013 | |
| WO | WO 2014/179620 | 11/2014 | |
| WO | WO 2014/179627 | 11/2014 | |
| WO | WO-2018098328 A1 * | 5/2018 | A61P 43/00 |
| WO | WO-2019099610 A1 * | 5/2019 | C12N 15/113 |
| WO | WO 2000/22113 | 4/2022 | |
| WO | 2025/199455 A1 | 9/2025 | |

OTHER PUBLICATIONS

NCBI GRB10 (2000. *Homo sapiens* insulin receptor binding protein [Grb-IR/hGrb10] mRNA, complete cds, GenBank: AF001534.1) (Year: 2000).*

Uprichard (2005. The therapeutic potential of RNA interference. FEBS Lett. 579:5996-6007) (Year: 2005).*

Kamola (et al. 2015. The siRNA Non-seed Region and Its Target Sequences Are Auxiliary Determinants of Off-Target Effects. PLoS Comput. Biol 11[12]:e1004656) (Year: 2015).*

Leuschner (et al. 2006. Cleavage of the siRNA passenger strand during RISC assembly in human cells. EMBO Rep. 7[3]:314-320) (Year: 2006).*

Carre' et al., "Dual Effect of the Adapter Growth Factor Receptor-Bound Protein 14 (Grb14) on Insulin Action in Primary Hepatocytes," Endocrinology, 2008, 149(6):3109-3117.

Ding et al., "Inhibition of Grb14, a negative modulator of insulin signaling, improves glucose homeostasis without causing cardiac dysfunction," Scientific Reports, 2020, 10:3417, 10 pp.

Edick et al., "Role of Grb10 in mTORC1-dependent regulation of insulin signaling and action in human skeletal muscle cells," Am J Physiol Endocrinol Metab, 2020, 318:E173-E183.

Popineau et al., "Novel Grb14-Mediated Cross Talk between Insulin and p62/Nrf2 Pathways Regulates Liver Lipogenesis and Selective Insulin Resistance," Mol Cell Biol, 2016, 36(16):2168-2181.

Partial Supplementary European Search Report issued Oct. 18, 2024, in European patent application No. 21867597.3.

Extended European Search Report issued Feb. 5, 2025, in European patent application No. 21867597.3.

Holt et al., "Dual Ablation of Grb10 and Grb14 in Mice Reveals Their Combined Role in Regulation of Insulin Signaling and Glucose Homeostasis," Mol Endocrinol, Sep. 2009, 23(9):1406-1414.

Invitation to Pay Additional Fees issued Nov. 24, 2021, in PCT application No. PCT/US2021/049663.

International Search Report and Written Opinion issued Mar. 7, 2022, in PCT application No. PCT/US2021/049663.

(56) References Cited

OTHER PUBLICATIONS

Aigner, "Delivery Systems for the Direct Application of siRNAs to Induce RNA Interference (RNAi) In Vivo," J. Biomed. Biotechnol., 2006, 2006:71659, 15 pp.
Akaneya et al., "RNAi-Induced Gene Silencing by Local Electroporation in Targeting Brain Region," J. Neurophysiol., 2005, 93:594-602.
Akhtar & Juliano, "Cellular uptake and intracellular fate of antisense oligonucleotides," Trends Cell. Biol., 1992, 2(5):139-144.
Allen & Chonn, "Large unilamellar liposomes with low uptake into the reticuloendothelial system," FEBS Letters, 1987, 223(1):42-46.
Aoki et al., "Potential tumor-targeting peptide vector of histidylated oligolysine conjugated to a tumor-homing RGD motif," Cancer Gene Therapy, 2001, 8(10):783-787.
Arnold et al., "Specific beta1-adrenergic receptor silencing with small interfering RNA lowers high blood pressure and improves cardiac function in myocardial ischemia," J. Hypertens., 2007, 25(1):197-205.
Barrett et al., "Preclinical models for obesity research," Dis. Models Mech., 2016, 9:1245-1255.
Bernstein et al., "Role for a bidentate ribonuclease in the initiation step of RNA interference," Nature, 2001, 409:363-366.
Bitko et al., "Inhibition of respiratory viruses by nasally administered siRNA," Nat. Med., 2005, 11:50-55; published online Dec. 26, 2004.
Blume & Cevc, "Liposomes for the sustained drug release in vivo," Biochimica et Biophysica Acta, 1990, 1029:91-97.
Boesen et al., "Circumvention of chemotherapy-induced myelosuppression by transfer of the mdr1 gene," Biotherapy, 1994, 6:291-302.
Bonnet et al., "Systemic Delivery of DNA or siRNA Mediated by Linear Polyethylenimine (L-PEI) Does Not Induce an Inflammatory Response," Pharm. Res., 2008, 25(12):2972-2982; Epub Aug. 16, 2008.
Bout et al., "Lung Gene Therapy: In Vivo Adenovirus-Mediated Gene Transfer to Rhesus Monkey Airway Epithelium," Hum. Gene Ther., 1994, 5:3-10.
Buur et al., "Penetration of 5-Fluorouracil and Prodrugs Across the Intestine of the Albino Rabbit: Evidence for Shift in Absorption Site from the Upper to the Lower Region of the Gastrointestinal Tract by Prodrugs," J. Control Rel., 1990, 14:43-51.
Charalambous et al., "Disruption of the imprinted Grb10 gene leads to disproportionate overgrowth by an Igf2-independent mechanism," PNAS, 2003, 100(14):8292-8297.
Chien et al., "Novel cationic cardiolipin analogue-based liposome for efficient DNA and small interfering RNA delivery in vitro and in vivo," Cancer Gene Ther., 2005, 12:321-328.
Chu & Rana, "Potent RNAi by short RNA triggers," RNA, 2008, 14:1714-1719.
Clapper et al., "Diet-induced mouse model of fatty liver disease and non-alcoholic steatohepatitis reflecting clinical disease progression and methods of assessment," Am. J. Physiol. Gastrointest. Liver Physiol., 2013, 305:G483-G495.
Clowes et al., "Long-Term Biological Response of Injured Rat Carotid Artery Seeded with Smooth Muscle Cells Expressing Retrovirally Introduced Human Genes," J. Clin. Invest., 1994, 93:644-651.
Constantinides et al., "Formulation and Intestinal Absorption Enhancement Evaluation of Water-in-Oil Microemulsions Incorporating Medium-Chain Glycerides," Pharmaceutical Research, 1994, 11(10):1385-1390.
Cordero-Espinoza & Hutch," The balancing act of the liver: tissue regeneration versus fibrosis," J. Clin. Invest., 2018, 128(1):85-96.
Couture & Stinchcomb, "Anti-gene therapy: the use of ribozymes to inhibit gene function," Trends in Genetics, 1996, 12(12):510-515.
Crooke et al., "Pharmacokinetic Properties of Several Novel Oligonucleotide Analogs in mice," J. Pharmacol. Exp. Ther., 1996, 277:923-937.
Deng et al., "Growth Factor Receptor-binding Protein 10 (Grb10) as a Partner of Phosphatidylinositol 3-Kinase in Metabolic Insulin Action," J. Biol. Chem., 2003, 278(41):39311-39322.
Desbuquois et al., "Regulation of insulin and type 1 insulin-like growth factor signaling and action by the Grb10/14 and SH2B1/B2adaptor proteins," FEBS J., 2013, 280:794-816.
Di Paula et al., "Association of hGrb 10 Genetic Variations With Type 2 Diabetes in Caucasian Subjects," Diabetes Care, 2006, 29(5):1181-1182.
Di Paula et al., "GRB10 gene and type 2 diabetes in White," J. Intern. Med., 2010, 267(1):132-133.
Dias et al., "Antisense Oligonucleotides: Basic Concepts and Mechanisms," Mol Cancer Ther, 2002, 1:347-355.
Docherty & Clark, "Nutrient regulation of insulin gene expression," FASEB J., 1994, 8:20-27.
Doiron et al., "Lentivirus shRNA Grb10 targeting the pancreas induces apoptosis and improved glucose tolerance due to decreased plasma glucagon levels," Diabetologia, 2012, 55:719-728.
Dorn et al., "siRNA relieves chronic neuropathic pain," Nucleic Acids, 2004, 32:e49, 6 pp.
Du Plessis et al., "Topical delivery of liposomally encapsulated gamma-interferon," Antiviral Research, 1992, 18:259-265.
Dufresne & Smith, "The Adapter Protein GRB10 Is an Endogenous Negative Regulator of Insulin-Like Growth Factor Signaling," Endocrinology, 2005, 146(10):4399-4409.
Elbashir et al., "Functional anatomy of siRNAs for mediating efficient RNAi in *Drosophila melanogaster* embryo lysate," EMBO J., 2001, 20(23):6877-6888.
Elbashir et al., "RNA interference is mediated by 21-and 22-nucleotide RNAs, " Genes Dev., 2001, 15:188-200.
El-Hariri et al., "The Mitigating Effects of Phosphatidylcholines on Bile Salt- and Lysophosphatidylcholine-induced Membrane Damage," J. Pharm. Pharmacol., 1992, 44:651-654.
Elmén et al., "Locked nucleic acid (LNA) mediated improvements in siRNA stability and functionality," Nucleic Acids Research, 2005, 33(1):439-447.
Fisher et al., "Transduction with Recombinant Adeno-Associated Virus for Gene Therapy Is Limited by Leading-Strand Synthesis," J. Virol., 1996, 70(1):520-532.
Fluiter et al., "Filling the gap in LNA antisense oligo gapmers: the effects of unlocked nucleic acid (UNA) and 4'-C-hydroxymethyl-DNA modifications on RNase H recruitment and efficacy of an LNA gapmer," Mol. Biosyst., 2009, 5:838-843.
Gabizon & Papahadjopoulos, "Liposome formulations with prolonged circulation time in blood and enhanced uptake by tumors," Proc. Natl. Acad. Sci. USA, 1988, 85:6949-6953.
Gassmann et al., "Maintenance of an extrachromosomal plasmid vector in mouse embryonic stem cells," Proc. Natl. Acad. Sci. USA, 1995, 92:1292-1296.
Giovannone et al., "Two Novel Proteins That Are Linked to Insulin-like Growth Factor (IGF-I) Receptors by the Grb10 Adapter and Modulate IGF-I Signaling," J. Biol. Chem., 2003, 278(34):31564-31573.
Grossman & Wilson, "Retroviruses: delivery vehicle to the liver," Curr. Opin. in Genetics and Devel., 1993, 3:110-114.
Grünweller et al., "Comparison of different antisense strategies in mammalian cells using locked nucleic acids, 2'-O-methyl RNA, phosphorothioates and small interfering RNA," Nucleic Acids Research, 2003, 31(12):3185-3193.
Han et al., "The Grb7 family proteins: structure, interactions with other signaling molecules and potential cellular functions," Oncogene, 2001, 20:6315-6321.
Haubner et al., "Glycosylated RGD-Containing Peptides: Tracer for Tumor Targeting and Angiogenesis Imaging with Improved Biokinetics," J Nucl Med, 2001, 42:326-336.
Ho et al., "Preparation of Microemulsions Using Polyglycerol Fatty Acid Esters as Surfactant for the Delivery of Protein Drugs," J. Pharm. Sci., 1996, 85(2):138-143.
Holt & Siddle, "Grb10 and Grb14: enigmatic regulators of insulin action—and more?," Biochem. J., 2005, 388:393-406.
Howard et al., "RNA Interference in Vitro and in Vivo Using a Chitosan/siRNA Nanoparticle System," Mol. Ther., 2006, 14(4):476-484.

(56) References Cited

OTHER PUBLICATIONS

Hu et al., "Topical delivery of cyclosporin A from non-ionic liposomal systems : an in vivo/in vitro correlation study using hairless mouse skin," S.T.P. Pharma. Sci., 1994, 4(6):466-469.
Illum & Davis, "The organ uptake of intravenously administered colloidal particles can be altered using a non-ionic surfactant (Poloxamer 338)," FEBS Lett., 1984, 167(1):79-82.
Ishibashi et al., "Hypercholesterolemia in Low Density Lipoprotein Receptor Knockout Mice and its Reversal by Adenovirus-mediated Gene Delivery," J Clin Invest, 1993, 92(2):883-893.
Ishida et al., "Effects of atherogenic diet consumption on lipoproteins in mouse strains C57BL/6 and C3H," J. Lipid. Res., 1991, 32:559-568.
Jackson et al., "Expression profiling reveals off-target gene regulation by RNAi," Nat. Biot., 2003, 21(6):635-637.
Jensen et al., "Unlocked nucleic acid (UNA) and UNA derivatives: Thermal denaturation studies," Nuc. Acids Symp. Series, 2008, 52(1):133-134.
Kabanov et al., "A new class of antivirals: antisense oligonucleotides combined with a hydrophobic substituent effectively inhibit influenza virus reproduction and synthesis of virus-specific proteins in MDCK cells," FEBS Lett., 1990, 259(2):327-330.
Kiem et al., "Retrovirus-Mediated Gene Transduction Into Canine Peripheral Blood Repopulating Cells," Blood, 1994, 83(6):1467-1473.
Kim et al., "Synthetic dsRNA Dicer substrates enhance RNAi potency and efficacy," Nat Biotech, 2005, 23(2):222-226.
Kim et al., "Cholesteryl Oligoarginine Delivering Vascular Endothelial Growth Factor siRNA Effectively Inhibits Tumor Growth in Colon Adenocarcinoma," Mol. Ther., 2006, 14(3):343-350.
Kim et al., "Local and systemic delivery of VEGF siRNA using polyelectrolyte complex micelles for effective treatment of cancer," Journal of Controlled Release, 2008, 129:107-116.
Klibanov et al., "Amphipathic polyethyleneglycols effectively prolong the circulation time of liposomes," FEBS Lett., 1990, 268(1):235-237.
Kooner et al., "Genome-wide association study in people of South Asian ancestry identifies six novel susceptibility loci for type 2 diabetes," Nat. Genet., 2013, 43(10):984-989.
Kozarsky & Wilson, "Gene therapy: adenovirus vectors," Current Opinion in Genetics and Development, 1993, 3:499-503.
Kubo et al., "Chemically modified symmetric and asymmetric duplex RNAs: an enhanced stability to nuclease degradation and gene silencing effect," Biochem. Biophys. Res. Comm., 2008, 365:54-61; available online Oct. 29, 2007.
Lam et al., "A new type of synthetic peptide library for identifying ligand-binding activity," Nature, 1991, 354:82-84.
Lee et al., "Mucosal Penetration Enhancers for Facilitation of Peptide and Protein Drug Absorption," Critical Reviews in Therapeutic Drug Carrier Systems, 1991, 8(2):91-192.
Letsinger et al., "Cholesteryl-conjugated oligonucleotides: Synthesis, properties, and activity as inhibitors of replication of human immunodeficiency virus in cell culture," Proc. Natl. Acid. Sci. USA, 1989, 86:6553-6556.
Li et al., "Small dsRNAs induce transcriptional activation in human cells," Proc. Natl. Acad. Sci., U.S.A., 2006, 103(46):17337-17342.
Li et al., "Polyethylenimine-complexed Plasmid Particles Targeting Focal Adhesion Kinase Function as Melanoma Tumor Therapeutics," Mol. Ther., 2007, 15(3):515-523.
Lima et al., "Single-Stranded siRNAs Activate RNAi in Animals," Cell, 2012, 150:883-894.
Lin et al., "A Cytosine Analogue Capable of Clamp-Like Binding to a Guanine in Helical Nucleic Acids," J. Am. Chem. Soc., 1998, 120:8531-8532.
Lin et al., "siRNA-mediated off-target gene silencing triggered by a 7 nt complementation," Nucleic Acids Res., 2005, 33(14):4527-4535.
Liu, "Radiolabeled Multimeric Cyclic RGD Peptides as Integrin avB3 Targeted Radiotracers for Tumor Imaging," Mol. Pharm., 2006, 3(5):472-487.
Makimura et al., "Reducing hypothalamic AGRP by RNA interference increases metabolic rate and decreases body weight without influencing food intake," BMC Neurosci., 2002, 3:18, 6 pp.
Manning, et al., "A genome-wide approach accounting for body mass index identifies genetic variants influencing fasting glycemic traits and insulin resistance," Nat. Genet., 2013, 44(6):659-669.
Manoharan et al., "Chemical Modifications to Improve Uptake and Bioavailability of Antisense Oligonucleotides," Ann. N. Y. Acad. Sci., 1992, 660:306-309.
Manoharan et al., "Introduction of a Lipophilic Thioether Tether in the Minor Groove of Nucleic Acids for Antisense Applications," Biorg. Med. Chem. Let., 1993, 3(12):2765-2770.
Manoharan et al., "Cholic Acid-Oligonucleotide Conjugates for Antisense Applications," Biorg. Med. Chem. Let., 1994, 4(8):1053-1060.
Manoharan et al., "Lipidic Nucleic Acids," Tetrahedron Lett., 1995, 36(21):3651-3654.
Manoharan et al., "Oligonucleotide Conjugates: Alteration of the Pharmacokinetic Properties of Antisense Agents, " Nucleosides & Nucleotides, 1995, 14(3-5):969-973.
Martin et al., "A New Access to 2'-O-alkylated Ribonucleosides and Properties of 2'-O-Alkylated Oligoribonucleotides," Helv. Chim. Acta, 1995, 78:486-504 (including machine translation).
Mastrangeli et al., "Diversity of Airway Epithelial Cell Targets for In Vivo Recombinant Adenovirus-mediated Gene Transfer," J. Clin. Invest., 1993, 91:225-234.
Matsumoto et al., "An improved mouse model that rapidly develops fibrosis in non-alcoholic steatohepatitis," Int. J. Exp. Path., 2013, 94:93-103.
Matsuzawa et al., "Lipid-induced oxidative stress causes steatohepatitis in mice fed an atherogenic diet," 2007, Hepatology 46:1392-1403.
Mcnamara et al., "Cell type-specific delivery of siRNAs with aptamer-siRNA chimeras," Nat. Biotechnol., 2006, 24(8):1005-1015.
Mikhailov et al., "Synthesis of a New Class of Acyclic 2',5'- and 3',5'-Oligonucleotide Analogs Based on 9-[1,5- dihydroxy-4(S)-hydroxymethyl-3-oxapent-2(R)-yl]-adenine," Tetrahedron Letters, 1985, 26(17):2059-2062.
Miller et al., "Use of Retroviral Vectors for Gene Transfer and Expression," Meth. Enzymol., 1993, 217:581-599.
Mishra et al., "Improved leishmanicidal effect of phosphorotioate antisense oligonucleotides by LDL-mediated delivery," Biochim. Biophys. Acta, 1995, 1264:229-237.
Miyao et al., "Stability and Pharmacokinetic Characteristics of Oligonucleotides Modified at Terminal Linkages in Mice," Antisense Res Dev, 1995, 5:115-121.
Mook et al., "Evaluation of locked nucleic acid-modified small interfering RNA in vitro and in vivo," Mol Canc Ther, 2007, 6(3):833-843.
Muranishi, "Absorption Enhancers," Critical Reviews in Therapeutic Drug Carrier Systems, 1990, 7(1):1-33.
NCBI Reference Sequence: NC_000002.12, "*Homo sapiens* chromosome 2, GRCh38.p14 Primary Assembly," Mar. 20, 2023.
NCBI Reference Sequence: NC_000007.14, "*Homo sapiens* chromosome 7, GRCh38.p14 Primary Assembly," Mar. 20, 2023.
NCBI Reference Sequence: NG_012305.2, "*Homo sapiens* growth factor receptor bound protein 10 (GRB10), RefSeqGene (LRG_1032) on chromosome 7," Mar. 25, 2023.
NCBI Reference Sequence: NG_052839.1, "*Homo sapiens* growth factor receptor bound protein 14 (GRB14), RefSeqGene on chromosome 2," Nov. 9, 2022.
NCBI Reference Sequence: NM_001001549.3, "*Homo sapiens* growth factor receptor bound protein 10 (GRB10), transcript variant 2, mRNA," Jun. 4, 2023.
NCBI Reference Sequence: NM_001001550.3, "*Homo sapiens* growth factor receptor bound protein 10 (GRB10), transcript variant 3, mRNA," Jun. 4, 2023.
NCBI Reference Sequence: NM_001001555.3, "*Homo sapiens* growth factor receptor bound protein 10 (GRB10), transcript variant 4, mRNA," Jun. 4, 2023.
NCBI Reference Sequence: NM_001109093.1, "Rattus norvegicus growth factor receptor bound protein 10 (Grb10), mRNA," Apr. 11, 2021.

(56) References Cited

OTHER PUBLICATIONS

NCBI Reference Sequence: NM_001177629.1, "Mus musculus growth factor receptor bound protein 10 (Grb10), transcript variant 2, mRNA," Mar. 18, 2023.
NCBI Reference Sequence: NM_001257428.1, "Macaca mulatta growth factor receptor bound protein 10 (GRB10), mRNA," Feb. 21, 2022.
NCBI Reference Sequence: NM_001303422.2, "*Homo sapiens* growth factor receptor bound protein 14 (GRB14), transcript variant 2, mRNA," Dec. 18, 2022.
NCBI Reference Sequence: NM_001350815.2, "*Homo sapiens* growth factor receptor bound protein 10 (GRB10), transcript variant 5, mRNA," Jun. 4, 2023.
NCBI Reference Sequence: NM_001350816.3, "*Homo sapiens* growth factor receptor bound protein 10 (GRB10), transcript variant 6, mRNA," Jun. 4, 2023.
NCBI Reference Sequence: NM_001370603.1, "Mus musculus growth factor receptor bound protein 10 (Grb10), transcript variant 3, mRNA," Mar. 18, 2023.
NCBI Reference Sequence: NM_001371008.1, "*Homo sapiens* growth factor receptor bound protein 10 (GRB10), transcript variant 7, mRNA," Jun. 4, 2023.
NCBI Reference Sequence: NM_001371009.1, "*Homo sapiens* growth factor receptor bound protein 10 (GRB10), transcript variant 8, mRNA," Jun. 4, 2023.
NCBI Reference Sequence: NM_004490.3, "*Homo sapiens* growth factor receptor bound protein 14 (GRB14), transcript variant 1, mRNA," Dec. 18, 2022.
NCBI Reference Sequence: NM_010345.4, "Mus musculus growth factor receptor bound protein 10 (Grb10), transcript variant 1, mRNA," Mar. 19, 2023.
NCBI Reference Sequence: NM_016719.1, "Mus musculus growth factor receptor bound protein 14 (Grb14), mRNA," Aug. 13, 2022.
NCBI Reference Sequence: NM_031623.1, "Rattus norvegicus growth factor receptor bound protein 14 (Grb14), mRNA," Oct. 10, 2020.
NCBI Reference Sequence: XM_008258679.2, "Predicted: Oryctolagus cuniculus growth factor receptor bound protein 14 (GRB14), transcript variant X1, mRNA," Jun. 23, 2016.
NCBI Reference Sequence: XM_015110244.2, "Predicted: Macaca mulatta growth factor receptor bound protein 14 (GRB14), transcript variant X1, mRNA," Apr. 26, 2019.
NCBI Reference Sequence: XM_015110245.2, "Predicted: Macaca mulatta growth factor receptor bound protein 14 (GRB14), transcript variant X3, mRNA," Apr. 26, 2019.
NCBI Reference Sequence: XM_017337635.1, "Predicted: Oryctolagus cuniculus growth factor receptor bound protein 10 (GRB10), mRNA," Jun. 23, 2016.
NCBI Reference Sequence: XM_017342897.1, "Predicted: Oryctolagus cuniculus growth factor receptor bound protein 14 (GRB14), transcript variant X2, mRNA," Jun. 23, 2016.
NCBI Reference Sequence: XM_017342898.1, "Predicted: Oryctolagus cuniculus growth factor receptor bound protein 14 (GRB14), transcript variant X3, mRNA," Jun. 23, 2016.
NCBI Reference Sequence: XM_028830779.1, "Predicted: Macaca mulatta growth factor receptor bound protein 14 (GRB14), transcript variant X2, mRNA," Apr. 26, 2019.
Nielsen et al., "Sequence-Selective Recognition of DNA by Strand Displacement with a Thymine-Substituted Polyamide," Science, 1991, 254(5037):1497-1500.
NCBI Reference Sequence: NM_001350814.2, "*Homo sapiens* growth factor receptor bound protein 10 (GRB10), transcript variant 1, mRNA," Jun. 4, 2023.
Nykänen et al., "ATP Requirements and Small Interfering RNA Structure in the RNA Interference Pathway," Cell, 2001, 107(3):309-321.
Oberhauser & Wagner, "Effective incorporation of 2'-O-methyl-oligoribonucleotides into liposomes and enhanced cell association through modification with thiocholesterol," Nucl. Acids Res., 1992, 20(3):533-538.
Pal et al., "Systemic delivery of RafsiRNA using cationic cardiolipin liposomes silences Raf-1 expression and inhibits tumor growth in xenograft model of human prostate cancer," Int J. Oncol., 2005, 26:1087-1091.
Papahadjopoulos & Gabizon, "Targeting of Liposomes to Tumor Cells in Vivo," Ann. N.Y. Acad. Sci., 1987, 507(1):64-74.
Pillé et al., "Anti-RhoA and Anti-RhoC siRNAs Inhibit the Proliferation and Invasiveness of MDA-MB-231 Breast Cancer Cells in Vitro and in Vivo," Mol. Ther., 2005, 11(2):267-274.
Plasschaert & Bartolomei, "Tissue-specific regulation and function of Grb10 during growth and neuronal commitment," PNAS, 2015, 112(22):6841-6847.
Prokopenko et al., "A Central Role for GRB10 in Regulation of Islet Function in Man," PLOS Genet, 2014, 10(4):e1004235, 13 pp.
Rabinowitz et al., "Cross-Packaging of a Single Adeno-Associated Virus (AAV) Type 2 Vector Genome into Multiple AAV Serotypes Enables Transduction with Broad Specificity," J Virol, 2002, 76(2):791-801.
Ramos et al., "GRB10 Mediates Insulin-Stimulated Degradation of the Insulin Receptor: A Mechanism of Negative Regulation," Am. J. Physiol. Endocrinol. Metab., 2006, 290(6):E1262-1266.
Rampersaud et al., "Identification of Novel Candidate Genes for Type 2 Diabetes From a Genome-Wide Association Scan in the Old Order Amish," Diabetes, 2007, 56:3053-3062.
Reich et al., "Small interfering RNA (siRNA) targeting VEGF effectively inhibits ocular neovascularization in a mouse model," Mol. Vis., 2003, 9:210-216.
Ritschel, "Microemulsions for Improved Peptide Absorption from the Gastrointestinal Tract," Meth. Find. Exp. Clin. Pharmacol., 1991, 13(3):205-220.
Rosenfeld et al., "Adenovirus-Mediated Transfer of a Recombinant a1-Antitrypsin Gene to the Lung Epithelium in Vivo," Science, 1991, 252(5004):431-434.
Rosenfeld et al., "In Vivo Transfer of the Human Cystic Fibrosis Transmembrane Conductance Regulator Gene to the Airway Epithelium," Cell, 1992, 68:143-155.
Saison-Behmoaras et al., "Short modified antisense oligonucleotides directed against Ha-ras point mutation induce selective cleavage of the mRNA and inhibit T24 cells proliferation," EMBO J, 1991, 10(5):1111-1118.
Salmons & Günzburg, "Targeting of Retroviral Vectors for Gene Therapy," Human Gene Therapy, 1993, 4:129-141.
Samulski et al., "A Recombinant Plasmid From Which an Infectious Adeno-Associated Virus Genome Can Be Excised In Vitro and Its Use to Study Viral Replication," J. Virol., 1987, 61(10):3096-3101.
Samulski et al., "Helper-Free Stocks of Recombinant Adeno-Associated Viruses: Normal Integration Does Not Require Viral Gene Expression," J. Virol., 1989, 63(9):3822-3826.
Scott et al., "Large-scale association analyses identify new loci influencing glycemic traits and provide insight into the underlying biological pathways," Nat. Genet., 2012, 44(9):991-1005.
Sharp, "RNA interference—2001," Genes Dev., 2001, 15:485-490.
Shea et al., "Synthesis, hybridization properties and antiviral activity of lipid-oligodeoxynucleotide conjugates," Nucl. Acids Res., 1990, 18(13):3777-3783.
Shishkina et al., "Attenuation of a2A-Adrenergic Receptor Expression in Neonatal Rat Brain by RNA Interference or Antisense Oligonucleotide Reduced Anxiety in Adulthood," Neuroscience, 2004, 129:521-528.
Simeoni et al., "Insight into the mechanism of the peptide-based gene delivery system MPG: implications for delivery of siRNA into mammalian cells," Nucl. Acids Res., 2003, 31(11):2717-2724.
Sørensen et al., "Gene Silencing by Systemic Delivery of Synthetic siRNAs in Adult Mice," J. Mol. Biol., 2003, 327:761-766.
Soutschek et al., "Therapeutic silencing of an endogenous gene by systemic administration of modified siRNAs," Nature, 2004, 432:173-178.
Sunamoto et al., "Liposomal Membranes. V. Interaction of Zinc(II) Ion with Egg Phosphatidylcholine Liposomes," Bull. Chem. Soc. Jpn., 1980, 53(10):2778-2781.
Svinarchuk et al., "Inhibition of HIV proliferation in MT-4 cells by antisense oligonucleotide conjugated to lipophilic groups," Biochimie, 1993, 75:49-54.

(56) References Cited

OTHER PUBLICATIONS

Takahashi et al., "The Use of a Perfluorochemical Emulsion as a Vascular Perfusate in Drug Absorption," J. Pharm. Pharmacol., 1988, 40:252-257.
Takakura et al., "Uptake Characteristics of Oligonucleotides in the Isolated Rat Liver Perfusion System," Antisense Nucleic Acid Drug Dev., 1996, 6:177-183.
Tan et al., "Gene knockdown with intrathecal siRNA of NMDA receptor NR2B subunit reduces formalin-induced nociception in the rat," Gene Ther., 2005, 12:59-66.
Thakker et al., "Neurochemical and behavioral consequences of widespread gene knockdown in the adult mouse brain by using nonviral RNA interference," Proc. Natl. Acad. Sci. U.S.A., 2004, 101(49):17270-17275.
Tolentino et al., "Intravitreal Injection of Vascular Endothelial Growth Factor Small Interfering RNA Inhibits Growth and Leakage in a Nonhuman Primate, Laser-Induced Model of Choroidal Neovascularization," Retina, 2004, 24(1):132-138.
Tomalia et al., "Dendrimers as multi-purpose nanodevices for oncology drug delivery and diagnostic imaging," Biochem. Soc. Trans., 2007, 35(1):61-67.
Verma et al., "Small Interfering RNAs Directed against-Catenin Inhibit the in Vitro and in Vivo Growth of Colon Cancer Cells," Clin. Cancer Res., 2003, 9:1291-1300.
Walsh et al., "Gene Therapy for Human Hemoglobinopathies," Proc. Soc. Exp. Biol. Med., 1993, 204(3):289-300.
Wang & Huang, "Plasmid DNA Adsorbed to pH-sensitive Liposomes Efficiently Transforms the Target Cells," Biochem. Biophys. Res. Commun., 1987, 147(3):980-985.
Wang et al., "A packaging cell line for propagation of recombinant adenovirus vectors containing two lethal gene-region deletions," Gene Therapy, 1995, 2:775-783.
Wang et al., "Cyclohexene Nucleic Acids (CeNA): Serum Stable Oligonucleotides that Activate RNase H and Increase Duplex Stability with Complementary RNA," J. Am. Chem. Soc., 2000, 122:8595-8602.
Wang et al., "Peripheral Disruption of the Grb10 Gene Enhances Insulin Signaling and Sensitivity In Vivo," Mol. Cell Biol., 2007, 27(18):6497-6505.
Weiner et al., "Liposomes: A Novel Topical Delivery System for Pharmaceutical and Cosmetic Applications," Journal of Drug Targeting, 1994, 2:405-410.
Weistock et al., "Severe hypertriglyceridemia, reduced high density lipoprotein, and neonatal death in lipoprotein lipase knockout mice. Mild hypertriglyceridemia with impaired very low density lipoprotein clearance in heterozygotes," J. Clin. Invest., 1995, 96(6):2555-2568.
Wick et al., "Grb10 Inhibits Insulin-stimulated Insulin Receptor Substrate (IRS)-Phosphatidylinositol 3-Kinase/Akt Signaling Pathway by Disrupting the Association of IRS-1/IRS-2 with the Insulin Receptor," J. Biol. Chem., 2003, 278(10):8460-8467.
Wiegman et al., "Hepatic VLDL Production in ob/ob Mice Is Not Stimulated by Massive De Novo Lipogenesis but Is Less Sensitive to the Suppressive Effects of Insulin," Diabetes, 2003, 52:1081-1089.
Wu et al., "Increased Microvascular Permeability Contributes to Preferential Accumulation of Stealth Liposomes in Tumor Tissue," Cancer Research, 1993, 53:3765-3770.
Xia et al., "siRNA-mediated gene silencing in vitro and in vivo," Nat. Biotech., 2002, 20:1006-1010.
Xie et al., "Negative Regulation of Grb10 Interacting GYF Protein 2 on Insulin-Like Growth Factor-1 Receptor Signaling Pathway Caused Diabetic Mice Cognitive Impairment," PLoS One, 2014, 9(9):e108559, 11 pp.
Yamamoto et al., "Type 2 Diabetes Mellitus in a Non-Obese Mouse Model Induced by Meg1/Grb10 Overexpression," Exp. Anim., 2008, 57(4):385-395.
Yamamoto et al., "A Mechanistic Study on Enhancement of Rectal Permeability to Insulin in the Albino Rabbit," J. Pharm. Exp. Ther., 1992, 263(1):25-31.
Yamashita et al., "Effects of diclofenac sodium and disodium ethylenediaminetetraacetate on electrical parameters of the mucosal membrane and their relation to the permeability enhancing effects in the rat jejunum," J. Pharm. Pharmacol., 1987, 39:621-626.
Yamashita et al., "Effect of Adjuvants on Charge-Selective Permeability and Electrical Resistance of Rat Jejunal Membrane," J. Pharm. Sci., 1990, 79(7):579-583.
Yang et al., "Amelioration of Diabetic Mouse Nephropathy by Catalpol Correlates with Down-Regulation of Grb10 Expression and Activation of Insulin-Like Growth Factor 1 / Insulin-Like Growth Factor 1 Receptor Signaling," PLoS One, 2016, 11(3):e0151857, 12 pp.
Yoo et al., "PAMAM Dendrimers as Delivery Agents for Antisense Oligonucleotides," Pharm. Res., 1999, 16:1799-1804.
Zhang et al., "Disruption of Growth Factor Receptor-Binding Protein 10 in the Pancreas Enhances ß-Cell Proliferation and Protects Mice From Streptozotocin-Induced ß-Cell Apoptosis," Diabetes, 2012, 61:3189-3198.
Zhang et al., "Small Interfering RNA Targeting Heme Oxygenase-1 Enhances Ischemia-Reperfusion-induced Lung Apoptosis," J. Biol. Chem., 2004, 279(11):10677-10684.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties," J. Org. Chem., 2009, 74:118-134.
Zhou & Huang, "Targeted delivery of DNA by liposomes and polymers," Journal of Controlled Release, 1992, 19:269-274.
Zimmermann et al., "RNAi-mediated gene silencing in non-human primates," Nature, 2006, 441:111-114.
Zitzmann et al., " Arginine-glycine-aspartic acid (RGD)-peptide binds to both tumor and tumor endothelial cells in vivo.," Cancer Res., 2002, 62:5139-5143.

* cited by examiner

IRNA COMPOSITIONS AND METHODS FOR SILENCING GROWTH FACTOR RECEPTOR BOUND PROTEIN 10 (GRB10) OR GROWTH FACTOR RECEPTOR BOUND PROTEIN 14 (GRB14) IN THE LIVER

CROSS-REFERENCE TO RELATED APPLICATIONS

This application is a national phase application based on PCT/US2021/049663, filed on Sep. 9, 2021, which claims the benefit of priority to U.S. Provisional Application No. 63/076,281, filed on Sep. 9, 2020. The entire contents of the foregoing applications are hereby incorporated herein by reference.

SEQUENCE LISTING

The instant application contains a Sequence Listing which has been submitted electronically in ASCII format and is hereby incorporated by reference in its entirety. The ASCII copy, created on Sep. 9, 2021, is named A108868_1150WO_SL.txt and is 824,639 bytes in size.

BACKGROUND OF THE INVENTION

Growth factor receptor bound protein 10 (GRB10) and growth factor receptor bound protein 14 (GRB14) are adapter proteins that interact with receptor tyrosine kinases, including insulin receptor and IGF receptors. GRB10/14 negatively regulate signaling through insulin receptor and IGF-1 receptor and are associated with decreased insulin sensitivity. GRB10/14 have also been found to have affects on insulin production and secretion as well as glucagon secretion. Thus, GRB10 and GRB14 are highly involved in the regulation of the signaling pathways that are related to diabetes.

There is currently no cure for type 2 diabetes or type 1 diabetes. The current standard of care for subjects having diabetes includes, insulin injections, monitoring blood sugar levels, lifestyle modification and managing the associated comorbidities, e.g., hypertension, hyperlipidemia, nephropathy, neuropathy, obesity, etc. Accordingly, as the prevalence of diabetes has progressively increased over time and is expected to continue increasing, there is a need in the art for alternative treatments for subjects having diabetes, prediabetes, and/or insulin resistance.

SUMMARY OF THE INVENTION

The present invention provides iRNA compositions which effect the RNA-induced silencing complex (RISC)-mediated cleavage of RNA transcripts of a growth factor receptor bound protein 10 (GRB10) or growth factor receptor bound protein 14 (GRB14) gene. The GRB10, GRB14 gene may be within a cell, e.g., a cell within a subject, such as a human. The present invention also provides methods of using the iRNA compositions of the invention for inhibiting the expression of a GRB10 or GRB14 gene and/or for treating a subject who would benefit from inhibiting or reducing the expression of a GRB10 or GRB14 gene, e.g., a subject suffering or prone to suffering from a GRB10- or GRB14-associated disease, for example, diabetes.

Accordingly, in one aspect, the present invention provides a double stranded ribonucleic acid (dsRNA) agent for inhibiting expression of growth factor receptor bound protein 10 (GRB10) in a cell. The dsRNA agent includes a sense strand and an antisense strand, wherein the sense strand comprises at least 15 contiguous nucleotides differing by no more than 1, 2, or 3 nucleotides from the nucleotide sequence of any one of SEQ ID NOs: 1, 3, 5, 7, 9, 11, 13, and 15, and the antisense strand comprises at least 15 contiguous nucleotides differing by no more than 1, 2, or 3 nucleotides from the nucleotide sequence of any one of SEQ ID NOs: 2, 4, 6, 8, 10, 12, 14, and 16. In some embodiments, the dsRNA agent includes a sense strand and an antisense strand, wherein the sense strand comprises at least 15 contiguous nucleotides from the nucleotide sequence of any one of SEQ ID NOs: 1, 3, 5, 7, 9, 11, 13, and 15, and the antisense strand comprises at least 15 contiguous nucleotides from the nucleotide sequence of any one of SEQ ID NOs: 2, 4, 6, 8, 10, 12, 14, and 16.

In another aspect, the present invention provides a double stranded ribonucleic acid (dsRNA) agent for inhibiting expression of growth factor receptor bound protein 10 (GRB10) in a cell. The dsRNA agent includes a sense strand and an antisense strand forming a double stranded region, wherein said antisense strand comprises a region of complementarity to an mRNA encoding GRB10 which comprises at least 15 contiguous nucleotides differing by no more than 1, 2, or 3 nucleotides from any one of the antisense sequences listed in any one of Tables 3-6. In some embodiments, the dsRNA agent includes a sense strand and an antisense strand forming a double stranded region, wherein said antisense strand comprises a region of complementarity to an mRNA encoding GRB10 which comprises at least 15 contiguous nucleotides from any one of the antisense sequences listed in any one of Tables 3-6.

In one embodiment, the region of complementarity comprises at least 15 contiguous nucleotides differing by no more than 1, 2, or 3 nucleotides from nucleotides which are perfectly complementary to any 15 contiguous nucleotides positioned within nucleotides 851-873, 858-880, 865-887, 872-894, 879-901, 905-927, 912-934, 939-961, 946-968, 953-975, 960-982, 967-989, 974-996, 981-1003, 989-1011, 996-1018, 1003-1025, 1010-1032, 1032-1054, 1040-1062, 1074-1096, 1083-1105, 1090-1112, 1128-1150, 1135-1157, 1162-1184, 1169-1191, 1176-1198, 1183-1205, 1190-1212, 1214-1236, 1221-1243, 1228-1250, 1253-1275, 1260-1282, 1267-1289, 1304-1326, 1311-1333, 1318-1340, 1325-1347, 1332-1354, 1339-1361, 1346-1368, 1353-1375, 1360-1382, 1367-1389, 1374-1396, 1381-1403, 1388-1410, 1395-1417, 1402-1424, 1409-1431, 1416-1438, 1423-1445, 1431-1453, 1438-1460, 1461-1483, 1468-1490, 1475-1497, 1482-1504, 1489-1511, 1496-1518, 1503-1525, 1510-1532, 1517-1539, 1525-1547, 1532-1554, 1539-1561, 1546-1568, 1577-1599, 1584-1606, 1591-1613, 1598-1620, 1605-1627, 1612-1634, 1619-1641, 1646-1668, 1653-1675, 1660-1682, 1686-1708, 1693-1715, 1700-1722, 1722-1744, 1729-1751, 1736-1758, 1743-1765, 1750-1772, 1757-1779, 1784-1806, 1806-1828, 1813-1835, 1820-1842, 1827-1849, 1834-1856, 1841-1863, 1868-1890, 1895-1917, 1902-1924, 1909-1931, 1916-1938, 1923-1945, 1930-1952, 1937-1959, 1944-1966, 1951-1973, 1958-1980, 1965-1987, 1994-2016, 2001-2023, 2008-2030, 2015-2037, 2022-2044, 2029-2051, 2072-2094, 2079-2101, 2086-2108, 2108-2130, 2115-2137, 2122-2144, 2129-2151, 2136-2158, 2189-2211, 2196-2218, 2203-2225, 2229-2251, 2256-2278, 2263-2285, 2270-2292, 2277-2299, 2284-2306, 2291-2313, 2298-2320, 2305-2327, 2312-2334, or 2319-2341 of SEQ ID NO: 1. In some embodiments, the region of complementarity comprises at least 15 contiguous nucleotides which are perfectly complementary to any 15 contiguous nucleotides positioned within nucleotides 851-873, 858-880, 865-887, 872-894, 879-901, 905-927, 912-934, 939-961, 946-968, 953-975, 960-982, 967-989, 974-996, 981-1003, 989-1011, 996-1018, 1003-1025, 1010-1032, 1032-1054, 1040-1062, 1074-1096, 1083-1105, 1090-1112, 1128-1150, 1135-1157, 1162-1184, 1169-1191, 1176-1198, 1183-1205, 1190-1212, 1214-1236, 1221-1243, 1228-1250, 1253-1275, 1260-1282, 1267-1289, 1304-1326, 1311-1333, 1318-1340, 1325-1347, 1332-1354, 1339-1361, 1346-1368, 1353-1375, 1360-1382, 1367-1389, 1374-1396, 1381-1403, 1388-1410, 1395-1417, 1402-1424, 1409-1431, 1416-1438, 1423-1445, 1431-1453, 1438-1460, 1461-1483, 1468-1490, 1475-1497, 1482-1504, 1489-1511, 1496-1518, 1503-1525, 1510-1532, 1517-1539, 1525-1547, 1532-1554, 1539-1561, 1546-1568, 1577-1599, 1584-1606, 1591-1613, 1598-1620, 1605-1627, 1612-1634, 1619-1641, 1646-1668, 1653-1675, 1660-1682, 1686-1708, 1693-1715, 1700-1722, 1722-1744, 1729-1751, 1736-1758, 1743-1765, 1750-1772, 1757-1779, 1784-1806, 1806-1828, 1813-1835, 1820-1842, 1827-1849, 1834-1856, 1841-1863, 1868-1890, 1895-1917, 1902-1924, 1909-1931, 1916-1938, 1923-1945, 1930-1952, 1937-1959, 1944-1966, 1951-1973, 1958-1980, 1965-1987, 1994-2016, 2001-2023, 2008-2030, 2015-2037, 2022-2044, 2029-2051, 2072-2094, 2079-2101, 2086-2108, 2108-2130, 2115-2137, 2122-2144, 2129-2151, 2136-2158, 2189-2211, 2196-2218, 2203-2225, 2229-2251, 2256-2278, 2263-2285, 2270-2292, 2277-2299, 2284-2306, 2291-2313, 2298-2320, 2305-2327, 2312-2334, or 2319-2341 of SEQ ID NO: 1.

In one embodiment, the dsRNA agent comprises at least one modified nucleotide.

In one embodiment, substantially all of the nucleotides of the sense strand comprise a modification. In another embodiment, substantially all of the nucleotides of the antisense strand comprise a modification. In yet another embodiment, substantially all of the nucleotides of the sense strand and substantially all of the nucleotides of the antisense strand comprise a modification.

In one aspect, the present invention provides a double stranded ribonucleic acid (dsRNA) agent for inhibiting expression of growth factor receptor bound protein 10 (GRB10) in a cell. The dsRNA agent includes a sense strand and an antisense strand forming a double stranded region, wherein the sense strand comprises at least 15 contiguous nucleotides differing by no more than 1, 2, or 3 nucleotides from the nucleotide sequence of any one of SEQ ID NOs: 1, 3, 5, 7, 9, 11, 13, and 15, and the antisense strand comprises at least 15 contiguous nucleotides differing by no more than 1, 2, or 3 nucleotides from the nucleotide sequence of any one of SEQ ID NOs: 2, 4, 6, 8, 10, 12, 14, and 16, wherein substantially all of the nucleotides of the sense strand and substantially all of the nucleotides of the antisense strand are modified nucleotides, and wherein the sense strand is conjugated to a ligand attached at the 3'-terminus. In some embodiments, the dsRNA agent includes a sense strand and an antisense strand forming a double stranded region, wherein the sense strand comprises at least 15 contiguous nucleotides from the nucleotide sequence of any one of SEQ ID NOs: 1, 3, 5, 7, 9, 11, 13, and 15, and the antisense strand comprises at least 15 contiguous nucleotides from the nucleotide sequence of any one of SEQ ID NOs: 2, 4, 6, 8, 10, 12, 14, and 16, wherein substantially all of the nucleotides of the sense strand and substantially all of the nucleotides of the antisense strand are modified nucleotides, and wherein the sense strand is conjugated to a ligand attached at the 3'-terminus.

In one embodiment, all of the nucleotides of the sense strand comprise a modification. In another embodiment, all of the nucleotides of the antisense strand comprise a modification. In yet another embodiment, all of the nucleotides of the sense strand and all of the nucleotides of the antisense strand comprise a modification.

In one embodiment, at least one of said modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O—(N-methylacetamide) modified nucleotide, and combinations thereof.

In one embodiment, the nucleotide modifications are 2'-O-methyl and/or 2'-fluoro modifications.

The region of complementarity may be at least 17 nucleotides in length; 19 to 30 nucleotides in length; 19-25 nucleotides in length; or 21 to 23 nucleotides in length.

Each strand may be no more than 30 nucleotides in length, e.g., each strand is independently 19-30 nucleotides in length; each strand is independently 19-25 nucleotides in length; each strand is independently 21-23 nucleotides in length.

The dsRNA may include at least one strand that comprises a 3' overhang of at least 1 nucleotide; or at least one strand that comprises a 3' overhang of at least 2 nucleotides.

In some embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is

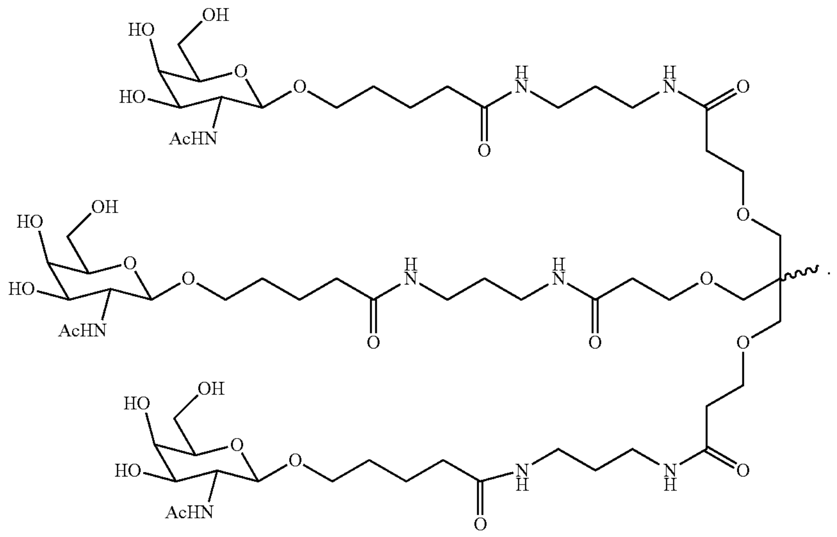 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the dsRNA agent is conjugated to the ligand as shown in the following schematic

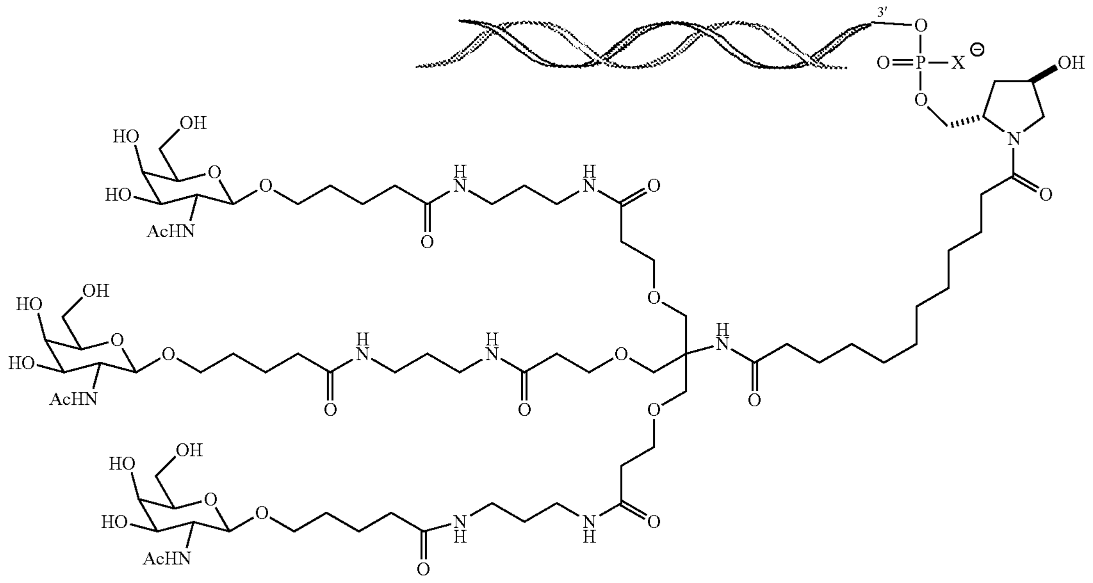

and, wherein X is O or S.

In one embodiment, the X is O.

In one embodiment, the region of complementarity comprises any one of the antisense sequences in any one of Tables 3-6.

In one aspect, the present invention provides a double stranded for inhibiting expression of growth factor receptor bound protein 10 (GRB10) in a cell. The dsRNA agent includes a sense strand complementary to an antisense strand, wherein the antisense strand comprises a region complementary to part of an mRNA encoding GRB10, wherein each strand is about 14 to about 30 nucleotides in length, wherein said dsRNA agent is represented by formula (III):

$$\text{sense: } 5'n_p\text{-}N_a\text{—}(XXX)_i\text{—}N_b\text{—}YYY\text{—}N_b\text{—}(ZZZ)_j\text{—}N_a\text{-}n_q3'$$

$$\text{antisense: } 3'n_p'\text{—}N_a'\text{—}(X'X'X')_k\text{—}N_b'\text{—}Y'Y'Y'\text{—}N_b'\text{—}(Z'Z'Z')_l\text{—}N_a'\text{-}n_q'5' \qquad \text{(III)}$$

wherein:

i, j, k, and l are each independently 0 or 1;

p, p', q, and q' are each independently 0-6;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b'$ independently represents an oligonucleotide sequence comprising 0-10 nucleotides which are either modified or unmodified or combinations thereof;

each $n_p$, $n_p'$, $n_q$, and $n_q'$, each of which may or may not be present, independently represents an overhang nucleotide;

XXX, YYY, ZZZ, X'X'X', Y'Y'Y', and Z'Z'Z' each independently represent one motif of three identical modifications on three consecutive nucleotides;

modifications on $N_b$ differ from the modification on Y and modifications on $N_b'$ differ from the modification on Y'; and wherein the sense strand is conjugated to at least one ligand.

In one embodiment, i is 0; j is 0; i is 1; j is 1; both i and j are 0; or both i and j are 1. In another embodiment, k is 0; l is 0; k is 1; l is 1; both k and l are 0; or both k and l are 1.

In one embodiment, XXX is complementary to X'X'X', YYY is complementary to Y'Y'Y', and ZZZ is complementary to Z'Z'Z'.

In one embodiment, the YYY motif occurs at or near the cleavage site of the sense strand, e.g., the Y'Y'Y' motif occurs at the 11, 12 and 13 positions of the antisense strand from the 5'-end.

In one embodiment, formula (III) is represented by formula (IIIa):

sense: $5' n_p$-$N_a$—YYY—$N_a$-$n_q$ 3' antisense: $3' n_{p'}$—$N_{a'}$—Y'Y'Y'—$N_{a'}$-$n_{q'}$ 5' (IIIa).

In another embodiment, formula (III) is represented by formula (IIIb):

sense: $5' n_p$-$N_a$—YYY—$N_b$—ZZZ—$N_a$-$n_q$ 3' antisense: $3' n_{p'}$—$N_{a'}$—Y'Y'Y'—$N_{b'}$—Z'Z'Z'—$N_{a'}$-$n_{q'}$ 5' (IIIb)

wherein each $N_b$ and $N_b'$ independently represents an oligonucleotide sequence comprising 1-5 modified nucleotides.

In yet another embodiment, formula (III) is represented by formula (IIIc):

sense: $5' n_p$-$N_a$—XXX—$N_b$—YYY—$N_a$-$n_q$ 3' antisense: $3' n_{p'}$—$N_{a'}$—X'X'X'—$N_{b'}$—Y'Y'Y'—$N_{a'}$-$n_{q'}$ 5' (IIIc)

wherein each $N_b$ and $N_b'$ independently represents an oligonucleotide sequence comprising 1-5 modified nucleotides.

In another embodiment, formula (III) is represented by formula (IIId):

sense: $5' n_p$-$N_a$—XXX—$N_b$—YYY—$N_b$—ZZZ—$N_a$-$n_q$ 3' antisense: $3' n_{p'}$—$N_{a'}$—X'X'X'—$N_{b'}$—Y'Y'Y'—$N_{b'}$—Z'Z'Z'—$N_{a'}$-$n_{q'}$ 5' (IIId)

wherein each $N_b$ and $N_b'$ independently represents an oligonucleotide sequence comprising 1-5 modified nucleotides and each $N_a$ and $N_a'$ independently represents an oligonucleotide sequence comprising 2-10 modified nucleotides.

The region of complementarity may be at least 17 nucleotides in length; 19 to 30 nucleotides in length; 19-25 nucleotides in length; or 21 to 23 nucleotides in length.

Each strand may be no more than 30 nucleotides in length, e.g., each strand is independently 19-30 nucleotides in length.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-O-methyl, 2'-deoxy, 2'-hydroxyl, and combinations thereof.

In one embodiment, the modifications on the nucleotides are 2'-O-methyl or 2'-fluoro modifications.

In one embodiment, the Y' is a 2'-O-methyl or 2'-flouro modified nucleotide.

In one embodiment, at least one strand of the dsRNA agent may comprise a 3' overhang of at least 1 nucleotide; or a 3' overhang of at least 2 nucleotides.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand. In one embodiment, the strand is the antisense strand. In another embodiment, the strand is the sense strand.

In one embodiment, the phosphorothioate or methylphosphonate internucleotide linkage is at the 5'-terminus of one strand. In one embodiment, the strand is the antisense strand. In another embodiment, the strand is the sense strand.

In one embodiment, the strand is the antisense strand. In another embodiment, the strand is the sense strand.

In one embodiment, the phosphorothioate or methylphosphonate internucleotide linkage is at both the 5'- and 3'-terminus of one strand.

In one embodiment, the base pair at the 1 position of the 5'-end of the antisense strand of the duplex is an AU base pair.

In one embodiment, p'>0. In another embodiment, p'=2.

In one embodiment, q'=0, p=0, q=0, and p' overhang nucleotides are complementary to the target mRNA. In another embodiment, q'=0, p=0, q=0, and p' overhang nucleotides are non-complementary to the target mRNA.

In one embodiment, the sense strand has a total of 21 nucleotides and the antisense strand has a total of 23 nucleotides.

In one embodiment, at least one $n_p'$ is linked to a neighboring nucleotide via a phosphorothioate linkage. In another embodiment, wherein all $n_p'$ are linked to neighboring nucleotides via phosphorothioate linkages.

In one embodiment, all of the nucleotides of the sense strand and all of the nucleotides of the antisense strand comprise a modification.

In one embodiment, the ligand is conjugated to the 3' end of the sense strand of the dsRNA agent.

In one embodiment, the ligand is one or more N-acetylgalactosamine (GalNAc) derivatives attached through a monovalent, bivalent, or trivalent branched linker.

In one embodiment, the ligand is

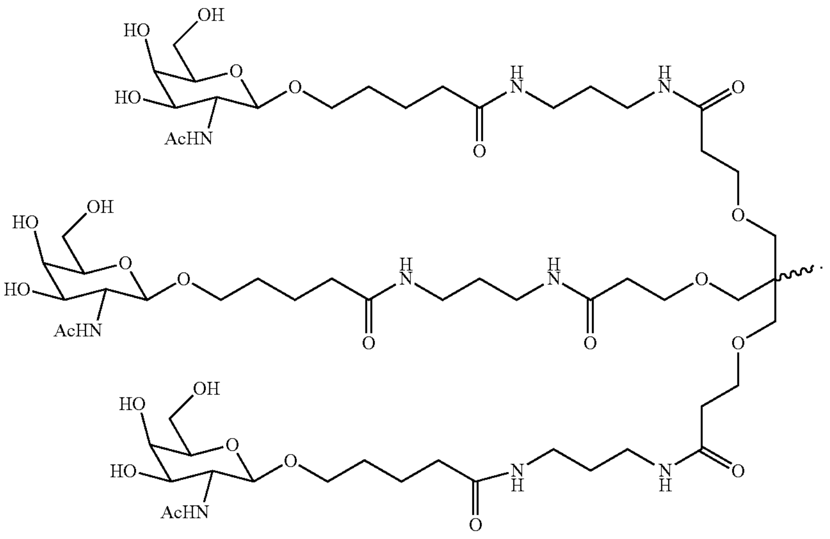

In one embodiment, the dsRNA agent is conjugated to the ligand as shown in the following schematic

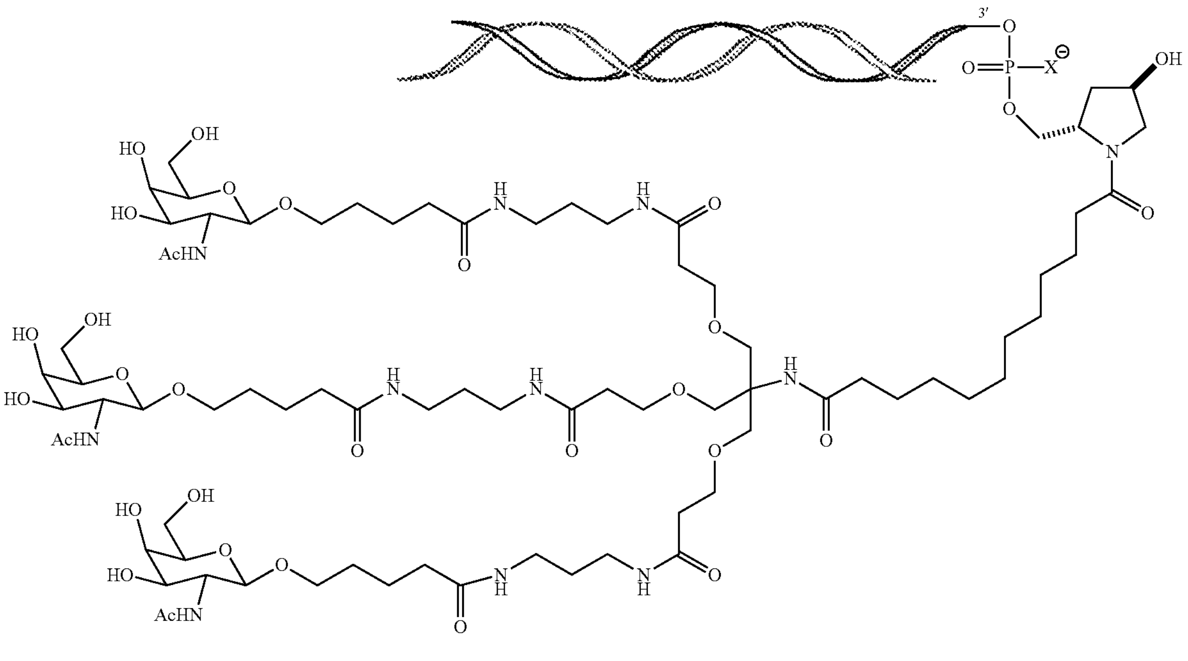

and, wherein X is O or S.

In one embodiment, the X is O.

In one aspect, the present invention provides a double stranded ribonucleic acid (dsRNA) agent for inhibiting the expression of growth factor receptor bound protein 10 (GRB10) in a cell. The dsRNA agent includes a sense strand complementary to an antisense strand, wherein the antisense strand comprises a region complementary to part of an mRNA encoding GRB10, wherein each strand is about 14 to about 30 nucleotides in length, wherein the dsRNA agent is represented by formula (III):

$$\text{sense: } 5'n_p\text{-}N_a\text{—}(XXX)_i N_b\text{—}YYY\text{—}N_b\text{—}(ZZZ)_j\text{—}N_a\text{-}n_q 3'$$

$$\text{antisense: } 3'n_p'\text{—}N_a'\text{—}(X'X'X')_k\text{—}N_b'\text{—}Y'Y'Y'\text{—}N_b'\text{—}(Z'Z'Z')\text{—}N_a'\text{-}n_q'5' \quad \text{(III)}$$

wherein:

i, j, k, and l are each independently 0 or 1;

p, p', q, and q' are each independently 0-6;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b'$ independently represents an oligonucleotide sequence comprising 0-10 nucleotides which are either modified or unmodified or combinations thereof, each $n_p$, $n_p'$, $n_q$, and $n_q'$, each of which may or may not be present independently represents an overhang nucleotide;

XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b'$ differ from the modification on Y'; and wherein the sense strand is conjugated to at least one ligand.

In one aspect, the present invention provides a double stranded ribonucleic acid (dsRNA) agent for inhibiting the expression of growth factor receptor bound protein 10 (GRB10) in a cell. The dsRNA agent includes a sense strand complementary to an antisense strand, wherein the antisense strand comprises a region complementary to part of an mRNA encoding GRB10, wherein each strand is about 14 to about 30 nucleotides in length, wherein the dsRNA agent is represented by formula (III):

sense: $5'n_p\text{-}N_a\text{—}(XXX)_i\text{—}N_b\text{—}YYY\text{—}N_b\text{—}(ZZZ)_j\text{—}N_a\text{-}n_q3'$ antisense: $3'n_p'\text{—}N_a'\text{—}(X'X'X')_k\text{—}N_b'\text{—}Y'Y'Y'\text{—}N_b'\text{—}(Z'Z'Z')\text{—}N_a'\text{-}n_q'5'$ (III)

wherein:

i, j, k, and l are each independently 0 or 1;

each $n_p$, $n_q$, and $n_q'$, each of which may or may not be present, independently represents an overhang nucleotide;

p, q, and q' are each independently 0-6;

$n_p'>0$ and at least one $n_p'$ is linked to a neighboring nucleotide via a phosphorothioate linkage;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b'$ independently represents an oligonucleotide sequence comprising 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b'$ differ from the modification on Y'; and wherein the sense strand is conjugated to at least one ligand.

In one aspect, the present invention provides a double stranded ribonucleic acid (dsRNA) agent for inhibiting the expression of growth factor receptor bound protein 10 (GRB10) in a cell. The dsRNA agent includes a sense strand complementary to an antisense strand, wherein the antisense strand comprises a region complementary to part of an mRNA encoding GRB10, wherein each strand is about 14 to about 30 nucleotides in length, wherein the dsRNA agent is represented by formula (III):

sense: $5'n_p\text{-}N_a\text{—}(XXX)_i\text{—}N_b\text{—}YYY\text{—}N_b\text{—}(ZZZ)_j\text{—}N_a\text{-}n_q3'$ antisense: $3'n_p'\text{—}N_a'\text{—}(X'X'X')_k\text{—}N_b'\text{—}Y'Y'Y'\text{—}N_b'\text{—}(Z'Z'Z')_l\text{—}N_a'\text{-}n_q'5'$ (III)

wherein:

i, j, k, and l are each independently 0 or 1;

each $n_p$, $n_q$, and $n_q'$, each of which may or may not be present, independently represents an overhang nucleotide;

p, q, and q' are each independently 0-6;

$n_p'>0$ and at least one $n_p'$ is linked to a neighboring nucleotide via a phosphorothioate linkage;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b'$ independently represents an oligonucleotide sequence comprising 0-10 nucleotides which are either modified or unmodified or combinations thereof, XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b'$ differ from the modification on Y'; and wherein the sense strand is conjugated to at least one ligand, wherein the ligand is one or more GalNAc derivatives attached through a monovalent, bivalent, or trivalent branched linker.

In one aspect, the present invention provides a double stranded ribonucleic acid (dsRNA) agent for inhibiting the expression of growth factor receptor bound protein 10 (GRB10) in a cell. The dsRNA agent includes a sense strand complementary to an antisense strand, wherein the antisense strand comprises a region complementary to part of an mRNA encoding GRB10, wherein each strand is about 14 to about 30 nucleotides in length, wherein the dsRNA agent is represented by formula (III):

sense: $5'n_p\text{-}N_a\text{—}(XXX)_i\text{—}N_b\text{—}YYY\text{—}N_b\text{—}(ZZZ)_j\text{—}N_a\text{-}n_q3'$ antisense: $3'n_p'\text{—}N_a'\text{—}(X'X'X')_k\text{—}N_b'\text{—}Y'Y'Y'\text{—}N_b'\text{—}(Z'Z'Z')_1\text{—}N_a'\text{-}n_q'5'$ (III)

wherein:

i, j, k, and l are each independently 0 or 1;

each $n_p$, $n_q$, and $n_q'$, each of which may or may not be present, independently represents an overhang nucleotide;

p, q, and q' are each independently 0-6;

$n_p'>0$ and at least one $n_p'$ is linked to a neighboring nucleotide via a phosphorothioate linkage;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b'$ independently represents an oligonucleotide sequence comprising 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b'$ differ from the modification on Y';

wherein the sense strand comprises at least one phosphorothioate linkage; and wherein the sense strand is conjugated to at least one ligand, wherein the ligand is one or more GalNAc derivatives attached through a monovalent, bivalent, or trivalent branched linker.

In one aspect, the present invention provides a double stranded ribonucleic acid (dsRNA) agent for inhibiting the expression of growth factor receptor bound protein 10 (GRB10) in a cell. The dsRNA agent includes a sense strand complementary to an antisense strand, wherein the antisense strand comprises a region complementary to part of an mRNA encoding GRB10, wherein each strand is about 14 to about 30 nucleotides in length, wherein the dsRNA agent is represented by formula (III):

sense: $5'n_p$-$N_a$—YYY—$N_a$-$n_q3'$ antisense: $3'n_p'$—$N_a'$—Y'Y'Y'—$N_a'$-$n_q'5'$ (IIIa)

wherein:

each $n_p$, $n_q$, and $n_q'$, each of which may or may not be present, independently represents an overhang nucleotide;

p, q, and q' are each independently 0-6;

$n_p'>0$ and at least one $n_p'$ is linked to a neighboring nucleotide via a phosphorothioate linkage;

each $N_a$ and $N_a'$ independently represents an oligonucleotide sequence comprising 0-25 nucleotides which are either modified or unmodified or combinations thereof, each sequence comprising at least two differently modified nucleotides;

YYY and Y'Y'Y' each independently represent one motif of three identical modifications on three consecutive nucleotides, and wherein the modifications are 2'-O-methyl and/or 2'-fluoro modifications;

wherein the sense strand comprises at least one phosphorothioate linkage; and wherein the sense strand is conjugated to at least one ligand, wherein the ligand is one or more GalNAc derivatives attached through a monovalent, bivalent, or trivalent branched linker.

In one aspect, the present invention provides a double stranded ribonucleic acid (dsRNA) agent for inhibiting the expression of growth factor receptor bound protein 10 (GRB10) in a cell. The dsRNA agent includes a sense strand and an antisense strand forming a double stranded region, wherein the sense strand comprises at least 15 contiguous nucleotides differing by no more than 1, 2, or 3 nucleotides from the nucleotide sequence of any one of SEQ ID NOs: 1, 3, 5, 7, 9, 11, 13, and 15, and the antisense strand comprises at least 15 contiguous nucleotides differing by no more than 1, 2, or 3 nucleotides from the nucleotide sequence of any one of SEQ ID NOs: 2, 4, 6, 8, 10, 12, 14, and 16, wherein substantially all of the nucleotides of the sense strand comprise a modification selected from the group consisting of a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from the group consisting of a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a monovalent, bivalent or trivalent branched linker at the 3'-terminus. In some embodiments, the dsRNA agent includes a sense strand and an antisense strand forming a double stranded region, wherein the sense strand comprises at least 15 contiguous nucleotides from the nucleotide sequence of any one of SEQ ID NOs: 1, 3, 5, 7, 9, 11, 13, and 15, and the antisense strand comprises at least 15 contiguous nucleotides from the nucleotide sequence of any one of SEQ ID NOs: 2, 4, 6, 8, 10, 12, 14, and 16, wherein substantially all of the nucleotides of the sense strand comprise a modification selected from the group consisting of a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from the group consisting of a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a monovalent, bivalent or trivalent branched linker at the 3'-terminus.

In one embodiment, all of the nucleotides of the sense strand and all of the nucleotides of the antisense strand are modified nucleotides.

In one embodiment, the region of complementarity comprises any one of the antisense sequences listed in any one of Tables 3-6. In one embodiment, the agent is selected from the group consisting of AD-1302784, AD-1302785, AD-1302786, AD-1302787, AD-1302788, AD-1302789, AD-1302790, AD-1302791, AD-1302792, AD-1302793, AD-1302794, AD-1302795, AD-1302796, AD-1302797, AD-1302798, AD-1302799, AD-1302800, AD-1302801, AD-1302802, AD-1302803, AD-1302804, AD-1302805, AD-1302806, AD-1302807, AD-1302808, AD-1302809, AD-1302810, AD-1302811, AD-1302812, AD-1302813, AD-1302814, AD-1302815, AD-1302816, AD-1302817, AD-1302818, AD-1302819, AD-1302820, AD-1302821, AD-1302822, AD-1302823, AD-1302824, AD-1302825, AD-1302826, AD-1302827, AD-1302828, AD-1302829, AD-1302830, AD-1302831, AD-1302832, AD-1302833, AD-1302834, AD-1302835, AD-1302836, AD-1302837, AD-1302838, AD-1302839, AD-1302840, AD-1302841, AD-1302842, AD-1302843, AD-1302844, AD-1302845, AD-1302846, AD-1302847, AD-1302848, AD-1302849, AD-1302850, AD-1302851, AD-1302852, AD-1302853, AD-1302854, AD-1302855, AD-1302856, AD-1302857, AD-1302858, AD-1302859, AD-1302860, AD-1302861, AD-1302862, AD-1302863, AD-1302864, AD-1302865, AD-1302866, AD-1302867, AD-1302868, AD-1302869, AD-1302870, AD-1302871, AD-1302872, AD-1302873, AD-1302874, AD-1302875, AD-1302876, AD-1302877, AD-1302878, AD-1302879, AD-1302880, AD-1302881, AD-1302882, AD-1302883, AD-1302884, AD-1302885, AD-1302886, AD-1302887, AD-1302888, AD-1302889, AD-1302890, AD-1302891, AD-1302892, AD-1302893, AD-1302894, AD-1302895, AD-1302896, AD-1302897, AD-1302898, AD-1302899, AD-1302900, AD-1302901, AD-1302902, AD-1302903, AD-1302904, AD-1302905, AD-1302906, AD-1302907, AD-1302908, AD-1302909, AD-1302910, AD-1302911, AD-1302912, AD-1302913, AD-1302914, AD-1302915, AD-1302916, AD-1302917, AD-1302918, AD-1364730, AD-1365058, AD-1365135, AD-1365142, AD-1365149, AD-1365491, AD-1416437, AD-1416444, AD-1416451, AD-1416458, AD-1416465, AD-1416471, AD-1416478, AD-1416505, AD-1416512, AD-1416519, AD-1416526, AD-1416533, AD-1416540, AD-1416547, AD-1416555, AD-1416562, AD-1416569, AD-1416576, AD-1416578, AD-1416586, AD-1416611, AD-1416620, AD-1416627, AD-1416645, AD-1416652, AD-1416674, AD-1416681, AD-1416688, AD-1416695, AD-1416699, AD-1416706, AD-1416713, AD-1416716, AD-1416723, AD-1416730, AD-1416740, AD-1416764, AD-1416774, AD-1416781, AD-1416795, AD-1416802, AD-1416809, AD-1416816, AD-1416823, AD-1416830, AD-1416837, AD-1416841, AD-1416848, AD-1416855, AD-1416863, AD-1416870, AD-1416893, AD-1416900, AD-1416907, AD-1416914, AD-1416921, AD-1416928, AD-1416935, AD-1416942, AD-1416949, AD-1416957, AD-1416964, AD-1416971, AD-1416978, AD-1417009, AD-1417016, AD-1417023, AD-1417030, AD-1417037, AD-1417044, AD-1417051, AD-1417078, AD-1417085, AD-1417092, AD-1417118, AD-1417125, AD-1417132, AD-1417154, AD-1417161, AD-1417168, AD-1417175, AD-1417182, AD-1417189, AD-1417233, AD-1417240, AD-1417247, AD-1417254, AD-1417261, AD-1417268, AD-1417275, AD-1417302, AD-1417309, AD-1417316, AD-1417323, AD-1417330, AD-1417337, AD-1417344, AD-1417351, AD-1417358, AD-1417365, AD-1417372, AD-1417401, AD-1417408, AD-1417415, AD-1417422, AD-1417429, AD-1417436, AD-1417459, AD-1417466, AD-1417473, AD-1417495, AD-1417502, AD-1417509, AD-1417516, AD-1417523, AD-1417556, AD-1417563, AD-1417570, AD-1417576, AD-1417603, AD-1417610, AD-1417617, AD-1417624, AD-1417631, AD-1417638, AD-1417645, AD-1417652, AD-1417659, and AD-1417666.

In one embodiment, the sense strand and the antisense strand comprise nucleotide sequences selected from the group consisting of the nucleotide sequences of any one of the agents listed in any one of Tables 3-6.

The present invention also provides cells, vectors, and pharmaceutical compositions which include any of the dsRNA agents of the invention. The dsRNA agents may be formulated in an unbuffered solution, e.g., saline or water, or in a buffered solution, e.g., a solution comprising acetate, citrate, prolamine, carbonate, or phosphate or any combination thereof. In one embodiment, the buffered solution is phosphate buffered saline (PBS).

In one aspect, the present invention provides a method of inhibiting growth factor receptor bound protein 10 (GRB10) expression in a cell. The method includes contacting the cell with a dsRNA agent or a pharmaceutical composition of the invention, thereby inhibiting expression of GRB10 in the cell.

The cell may be within a subject, such as a human subject.

In one embodiment, the GRB10 expression is inhibited by at least 30%, 40%, 50%, 60%, 70%, 80%, 90%, 95%, or to below the level of detection of GRB10 expression.

In one embodiment, the human subject suffers from a GRB10-associated disease, disorder, or condition. In one embodiment, the GRB10-associated disease, disorder, or condition is diabetes. In one embodiment the diabetes is type 2 diabetes. In another embodiment, the diabetes is type 1 diabetes. In one embodiment, the GRB10-associated disease, disorder, or condition is prediabetes. In one embodiment, the GRB10-associated disease, disorder, or condition is insulin resistance. In one embodiment, the GRB10-associated disease, disorder, or condition is a diabetes-related disease, disorder, or condition. In one embodiment, the GRB10-associated disease, disorder, or condition is obesity, diabetic neuropathy, diabetic nephropathy, diabetic vasculopathy, diabetic retinopathy, hypertension, dyslipidemia, atherosclerosis, coronary heart disease, and stroke.

In one aspect, the present invention provides a method of inhibiting the expression of GRB10 in a subject. The methods include administering to the subject a therapeutically effective amount of a dsRNA agent or a pharmaceutical composition of the invention, thereby inhibiting the expression of GRB10 in the subject. In one embodiment, the subject has a GRB10-associated disease, disorder, or condition. In one embodiment, the GRB10-associated disease, disorder, or condition is diabetes. In one embodiment the diabetes is type 2 diabetes. In another embodiment, the diabetes is type 1 diabetes. In one embodiment, the GRB10-associated disease, disorder, or condition is prediabetes. In one embodiment, the GRB10-associated disease, disorder, or condition is insulin resistance. In one embodiment, the GRB10-associated disease, disorder, or condition is a diabetes-related disease, disorder, or condition. In one embodiment, the GRB10-associated disease, disorder, or condition is obesity, diabetic neuropathy, diabetic nephropathy, diabetic vasculopathy, diabetic retinopathy, hypertension, dyslipidemia, atherosclerosis, coronary heart disease, and stroke.

In another aspect, the present invention provides a method of treating a subject suffering from a GRB10-associated disease, disorder, or condition. The method includes administering to the subject a therapeutically effective amount of a dsRNA agent or a pharmaceutical composition of the invention, thereby treating the subject suffering from a GRB10-associated disease, disorder, or condition. In one embodiment, the GRB10-associated disease, disorder, or condition is diabetes. In one embodiment the diabetes is type 2 diabetes. In another embodiment, the diabetes is type 1 diabetes. In one embodiment, the GRB10-associated disease, disorder, or condition is prediabetes. In one embodiment, the GRB10-associated disease, disorder, or condition is insulin resistance. In one embodiment, the GRB10-associated disease, disorder, or condition is a diabetes-related disease, disorder, or condition. In one embodiment, the GRB10-associated disease, disorder, or condition is obesity, diabetic neuropathy, diabetic nephropathy, diabetic vasculopathy, diabetic retinopathy, hypertension, dyslipidemia, atherosclerosis, coronary heart disease, and stroke.

In another aspect, the present invention provides a method of preventing at least one symptom in a subject having a GRB10-associated disease, disorder, or condition. The method includes administering to the subject a prophylactically effective amount of the agent of a dsRNA agent or a pharmaceutical composition of the invention, thereby preventing at least one symptom in a subject having a GRB10-associated disease, disorder, or condition. In one embodiment, the GRB10-associated disease, disorder, or condition is diabetes. In one embodiment the diabetes is type 2 diabetes. In another embodiment, the diabetes is type 1 diabetes. In one embodiment, the GRB10-associated disease, disorder, or condition is prediabetes. In one embodiment, the GRB10-associated disease, disorder, or condition is insulin resistance. In one embodiment, the GRB10-associated disease, disorder, or condition is a diabetes-related disease, disorder, or condition. In one embodiment, the GRB10-associated disease, disorder, or condition is obesity, diabetic neuropathy, diabetic nephropathy, diabetic vasculopathy, diabetic retinopathy, hypertension, dyslipidemia, atherosclerosis, coronary heart disease, and stroke.

In another aspect, the present invention provides a method of reducing the risk of developing type 2 diabetes in a subject. The method includes administering to the subject a prophylactically effective amount or a prophylactically effective amount of a dsRNA agent or a pharmaceutical composition of the invention, thereby reducing the risk of developing type 2 diabetes in the subject.

In another aspect, the present invention provides a method of increasing insulin sensitivity in a subject. The method includes administering to the subject a therapeutically effective amount of a dsRNA agent or a pharmaceutical composition of the invention, thereby increasing insulin sensitivity in the subject. In one embodiment, the insulin sensitivity is hepatic insulin sensitivity.

In another aspect, the present invention provides a method of reversing type 2 diabetes in a subject. The method includes administering to the subject a therapeutically effective amount of a dsRNA agent or a pharmaceutical composition of the invention, thereby reversing type 2 diabetes in the subject.

In one embodiment, the subject is obese.

In one embodiment, the methods and uses of the invention further include administering an additional therapeutic to the subject.

In one embodiment, the dsRNA agent is administered to the subject at a dose of about 0.01 mg/kg to about 10 mg/kg or about 0.5 mg/kg to about 50 mg/kg.

The agent may be administered to the subject intravenously, intramuscularly, or subcutaneously.

In one embodiment, the agent is administered to the subject subcutaneously.

In one embodiment, the methods and uses of the invention further include determining, the level of GRB10 in the subject.

In one aspect, the present invention provides a double stranded ribonucleic acid (dsRNA) agent for inhibiting expression of growth factor receptor bound protein 10 (GRB10) in a cell, wherein the dsRNA agent comprises a sense strand and an antisense strand forming a double stranded region, wherein the sense strand comprises a nucleotide sequence of any one of the agents in any one of Tables 3-6, and the antisense strand comprises a nucleotide sequence of any one of the agents in any one of Tables 3-6, wherein substantially all of the nucleotide of the sense strand and substantially all of the nucleotides of the antisense strand are modified nucleotides, and wherein the dsRNA agent is conjugated to a ligand.

According to another aspect, the present invention provides a double stranded ribonucleic acid (dsRNA) agent for inhibiting expression of growth factor receptor bound protein 14 (GRB14) in a cell. The dsRNA agent includes a sense strand and an antisense strand, wherein the sense strand comprises at least 15 contiguous nucleotides differing by no more than 1, 2, or 3 nucleotides from the nucleotide sequence of any one of SEQ ID NOs: 29 and 31, and the antisense strand comprises at least 15 contiguous nucleotides differing by no more than 1, 2, or 3 nucleotides from the nucleotide sequence of any one of SEQ ID NOs: 30 and 32. In some embodiments, the dsRNA agent includes a sense strand and an antisense strand, wherein the sense strand comprises at least 15 contiguous nucleotides from the nucleotide sequence of any one of SEQ ID NOs: 29 and 31, and the antisense strand comprises at least 15 contiguous nucleotides from the nucleotide sequence of any one of SEQ ID NOs: 30 and 32.

In another aspect, the present invention provides a double stranded ribonucleic acid (dsRNA) agent for inhibiting expression of growth factor receptor bound protein 14 (GRB14) in a cell. The dsRNA agent includes a sense strand and an antisense strand forming a double stranded region, wherein said antisense strand comprises a region of complementarity to an mRNA encoding GRB14 which comprises at least 15 contiguous nucleotides differing by no more than 1, 2, or 3 nucleotides from any one of the antisense sequences listed in any one of Tables 7-10. In some embodiments, the dsRNA agent includes a sense strand and an antisense strand forming a double stranded region, wherein said antisense strand comprises a region of complementarity to an mRNA encoding GRB14 which comprises at least 15 contiguous nucleotides from any one of the antisense sequences listed in any one of Tables 7-10.

In one embodiment, the region of complementarity comprises at least 15 contiguous nucleotides differing by no more than 1, 2, or 3 nucleotides from nucleotides which are perfectly complementary to any 15 contiguous nucleotides positioned within nucleotides 162-184, 173-195, 347-369, 370-392, 381-403, 392-414, 403-425, 414-436, 425-447, 436-458, 447-469, 458-480, 469-491, 491-513, 502-524, 513-535, 524-546, 535-557, 546-568, 557-579, 568-590, 579-601, 590-612, 601-623, 612-634, 623-645, 634-656, 645-667, 656-678, 667-689, 678-700, 705-727, 740-762, 766-788, 777-799, 788-810, 799-821, 810-832, 834-856, 845-867, 856-878, 867-889, 878-900, 889-911, 900-922, 936-958, 949-971, 964-986, 975-997, 986-1008, 997-1019, 1008-1030, 1020-1042, 1031-1053, 1061-1083, 1072-1094, 1083-1105, 1094-1116, 1120-1142, 1131-1153, 1142-1164, 1153-1175, 1164-1186, 1175-1197, 1186-1208, 1197-1219, 1208-1230, 1219-1241, 1230-1252, 1241-1263, 1252-1274, 1263-1285, 1274-1296, 1285-1307, 1296-1318, 1307-1329, 1318-1340, 1329-1351, 1340-1362, 1351-1373, 1362-1384, 1373-1395, 1397-1419, 1408-1430, 1431-1453, 1442-1464, 1453-1475, 1464-1486, 1475-1497, 1486-1508, 1497-1519, 1508-1530, 1519-1541, 1530-1552, 1541-1563, 1552-1574, 1563-1585, 1587-1609, 1598-1620, 1627-1649, 1638-1660, 1649-1671, 1660-1682, 1671-1693, 1682-1704, 1693-1715, 1704-1726, 1715-1737, 1726-1748, 1737-1759, 1748-1770, 1759-1781, 1770-1792, 1781-1803, 1792-1814, 1803-1825, 1815-1837, 1850-1872, 1861-1883, 1872-1894, 1883-1905, 1894-1916, 1921-1943, 1932-1954, 1943-1965, 1954-1976, 2013-2035, 2024-2046, 2071-2093, 2082-2104, 2093-2115, 2104-2126, 2115-2137, 2134-2156, 2145-2167, 496-518, 499-521, 505-527, 508-530, 639-661, 642-664, 648-670, 651-673, 672-694, 675-697, 681-703, 708-730, 711-733, 743-765, 760-782, 782-804, 785-807, 791-813, 793-815, 794-816, 796-818, 802-824, 805-827, 839-861, 842-864, 848-870, 851-873, 861-883, 864-886, 870-892, 872-894, 873-895, 875-897, 881-903, 884-906, 991-1013, 994-1016, 1000-1022, 1002-1024, 1003-1025, 1005-1027, 1011-1033, 1014-1036, 1017-1039, 1023-1045, 1025-1047, 1026-1048, 1028-1050, 1034-1056, 1037-1059, 1064-1086, 1066-1088, 1067-1089, 1069-1091, 1075-1097, 1078-1100, 1202-1224, 1205-1227, 1211-1233, 1214-1236, 1246-1268, 1249-1271, 1255-1277, 1258-1280, 1268-1290, 1271-1293, 1277-1299, 1279-1301, 1280-1302, 1282-1304, 1288-1310, 1290-1312, 1291-1313, 1293-1315, 1299-1321, 1302-1324, 1480-1502, 1483-1505, 1489-1511, 1492-1514, 1546-1568, 1549-1571, 1555-1577, 1558-1580, 1590-1612, 1592-1614, 1593-1615, 1595-1617, 1601-1623, 1709-1731, 1712-1734, 1718-1740, 1721-1743, 1742-1764, 1745-1767, 1751-1773, 1754-1776, 1786-1808, 1789-1811, 1795-1817, 1798-1820, 1866-1888, 1869-1891, 1875-1897, 1877-1899, 1878-1900, 1880-1902, 1886-1908, 1889-1911, 1937-1959, 1940-1962, 1946-1968, 1949-1971, 684-706, 699-721, 702-724, 734-756, 737-759, 746-768, 763-785, 769-791, 772-794, 1055-1077, 1058-1080, 1581-1603, 1584-1606, or 1604-1626 of SEQ ID NO: 29. In some embodiments, the region of complementarity comprises at least 15 contiguous nucleotides which are perfectly complementary to any 15 contiguous nucleotides positioned within nucleotides 162-184, 173-195, 347-369, 370-392, 381-403, 392-414, 403-425, 414-436, 425-447, 436-458, 447-469, 458-480, 469-491, 491-513, 502-524, 513-535, 524-546, 535-557, 546-568, 557-579, 568-590, 579-601, 590-612, 601-623, 612-634, 623-645, 634-656, 645-667, 656-678, 667-689, 678-700, 705-727, 740-762, 766-788, 777-799, 788-810, 799-821, 810-832, 834-856, 845-867, 856-878, 867-889, 878-900, 889-911, 900-922, 936-958, 949-971, 964-986, 975-997, 986-1008, 997-1019, 1008-1030, 1020-1042, 1031-1053, 1061-1083, 1072-1094, 1083-1105, 1094-1116, 1120-1142, 1131-1153, 1142-1164, 1153-1175, 1164-1186, 1175-1197, 1186-1208, 1197-1219, 1208-1230, 1219-1241, 1230-1252, 1241-1263, 1252-1274, 1263-1285, 1274-1296, 1285-1307, 1296-1318, 1307-1329, 1318-1340, 1329-1351, 1340-1362, 1351-1373, 1362-1384, 1373-1395, 1397-1419, 1408-1430, 1431-1453, 1442-1464, 1453-1475, 1464-1486, 1475-1497, 1486-1508, 1497-1519, 1508-1530, 1519-1541, 1530-1552, 1541-1563, 1552-1574, 1563-1585, 1587-1609, 1598-1620, 1627-1649, 1638-1660, 1649-1671, 1660-1682, 1671-1693, 1682-1704, 1693-1715, 1704-1726, 1715-1737, 1726-1748, 1737-1759, 1748-1770, 1759-1781, 1770-1792, 1781-1803, 1792-1814, 1803-1825, 1815-1837, 1850-1872, 1861-1883, 1872-1894, 1883-1905, 1894-1916, 1921-1943, 1932-1954, 1943-1965, 1954-1976, 2013-2035, 2024-2046, 2071-2093, 2082-2104, 2093-2115, 2104-2126, 2115-2137, 2134-2156, 2145-2167, 496-518, 499-521, 505-527, 508-530, 639-661, 642-664, 648-670, 651-673, 672-694, 675-697, 681-703, 708-730, 711-733, 743-765, 760-782, 782-804, 785-807, 791-813, 793-815, 794-816, 796-818, 802-824, 805-827, 839-861, 842-864, 848-870, 851-873, 861-883, 864-886, 870-892, 872-894, 873-895, 875-897, 881-903, 884-906, 991-1013, 994-1016, 1000-1022, 1002-1024, 1003-1025, 1005-1027, 1011-1033, 1014-1036, 1017-1039, 1023-1045, 1025-1047, 1026-1048, 1028-1050, 1034-1056, 1037-1059, 1064-1086, 1066-1088, 1067-1089, 1069-1091, 1075-1097, 1078-1100, 1202-1224, 1205-1227, 1211-1233, 1214-1236, 1246-1268, 1249-1271, 1255-1277, 1258-1280, 1268-1290, 1271-1293, 1277-1299, 1279-1301, 1280-1302, 1282-1304, 1288-1310, 1290-1312, 1291-1313, 1293-1315, 1299-1321, 1302-1324, 1480-1502, 1483-1505, 1489-1511, 1492-1514, 1546-1568, 1549-1571, 1555-1577, 1558-1580, 1590-1612, 1592-1614, 1593-1615, 1595-1617, 1601-1623, 1709-1731, 1712-1734, 1718-1740, 1721-1743, 1742-1764, 1745-1767, 1751-1773, 1754-1776, 1786-1808, 1789-1811, 1795-1817, 1798-1820, 1866-1888, 1869-1891, 1875-1897, 1877-1899, 1878-1900, 1880-1902, 1886-1908, 1889-1911, 1937-1959, 1940-1962, 1946-1968, 1949-1971, 684-706, 699-721, 702-724, 734-756, 737-759, 746-768, 763-785, 769-791, 772-794, 1055-1077, 1058-1080, 1581-1603, 1584-1606, or 1604-1626 of SEQ ID NO: 29.

In one embodiment, the dsRNA agent comprises at least one modified nucleotide.

In one embodiment, substantially all of the nucleotides of the sense strand comprise a modification. In another embodiment, substantially all of the nucleotides of the antisense strand comprise a modification. In yet another embodiment, substantially all of the nucleotides of the sense strand and substantially all of the nucleotides of the antisense strand comprise a modification.

In one aspect, the present invention provides a double stranded ribonucleic acid (dsRNA) agent for inhibiting expression of growth factor receptor bound protein 14 (GRB14) in a cell. The dsRNA agent includes a sense strand and an antisense strand forming a double stranded region, wherein the sense strand comprises at least 15 contiguous nucleotides differing by no more than 1, 2, or 3 nucleotides from the nucleotide sequence of any one of SEQ ID NOs: 29 and 31, and the antisense strand comprises at least 15 contiguous nucleotides differing by no more than 1, 2, or 3 nucleotides from the nucleotide sequence of any one of SEQ ID NOs: 30 and 32, wherein substantially all of the nucleotides of the sense strand and substantially all of the nucleotides of the antisense strand are modified nucleotides, and wherein the sense strand is conjugated to a ligand attached at the 3'-terminus. In some embodiments, the dsRNA agent includes a sense strand and an antisense strand forming a double stranded region, wherein the sense strand comprises at least 15 contiguous nucleotides from the nucleotide sequence of any one of SEQ ID NOs: 29 and 31, and the antisense strand comprises at least 15 contiguous nucleotides from the nucleotide sequence of any one of SEQ ID NOs: 30 and 32, wherein substantially all of the nucleotides of the sense strand and substantially all of the nucleotides of the antisense strand are modified nucleotides, and wherein the sense strand is conjugated to a ligand attached at the 3'-terminus.

In one embodiment, all of the nucleotides of the sense strand comprise a modification. In another embodiment, all of the nucleotides of the antisense strand comprise a modification. In yet another embodiment, all of the nucleotides of the sense strand and all of the nucleotides of the antisense strand comprise a modification.

In one embodiment, at least one of said modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O—(N-methylacetamide) modified nucleotide, and combinations thereof.

In one embodiment, the nucleotide modifications are 2'-O-methyl and/or 2'-fluoro modifications.

The region of complementarity may be at least 17 nucleotides in length; 19 to 30 nucleotides in length; 19-25 nucleotides in length; or 21 to 23 nucleotides in length.

Each strand may be no more than 30 nucleotides in length, e.g., each strand is independently 19-30 nucleotides in length; each strand is independently 19-25 nucleotides in length; each strand is independently 21-23 nucleotides in length.

The dsRNA may include at least one strand that comprises a 3' overhang of at least 1 nucleotide; or at least one strand that comprises a 3' overhang of at least 2 nucleotides.

In some embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is

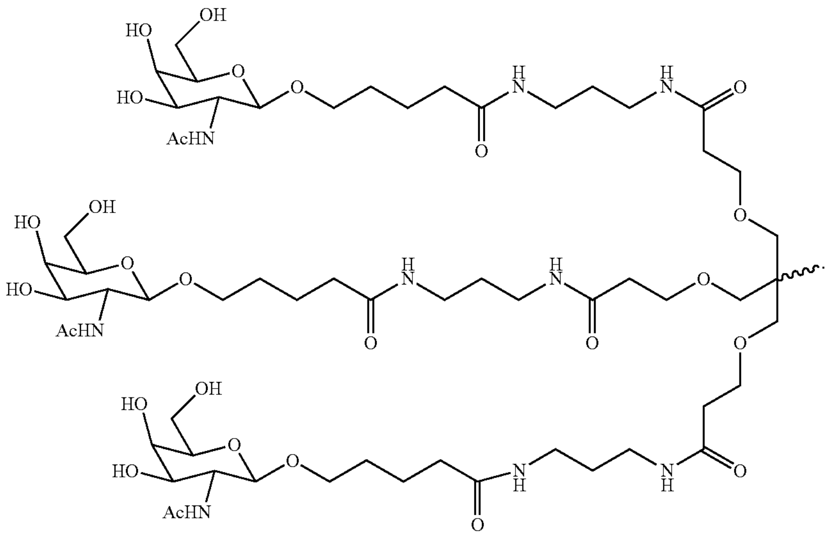

In one embodiment, the dsRNA agent is conjugated to the ligand as shown in the following schematic

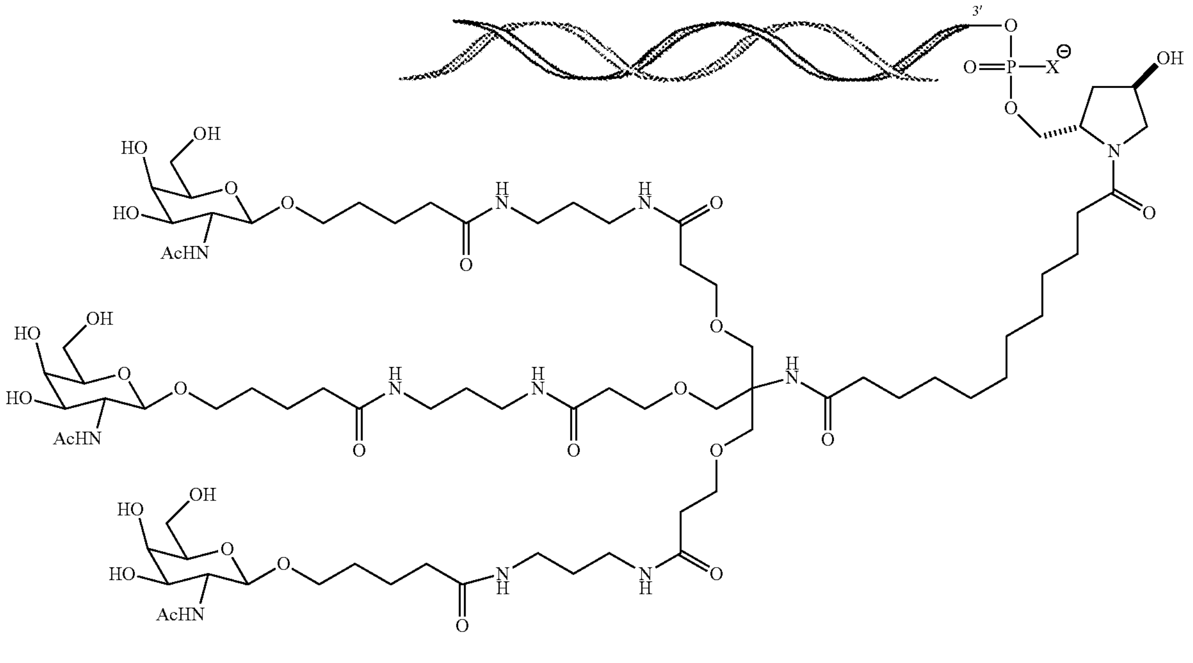

and, wherein X is O or S.

In one embodiment, the X is O.

In one embodiment, the region of complementarity comprises any one of the antisense sequences in any one of Tables 7-10.

In one aspect, the present invention provides a double stranded for inhibiting expression of growth factor receptor bound protein 14 (GRB14) in a cell. The dsRNA agent includes a sense strand complementary to an antisense strand, wherein the antisense strand comprises a region complementary to part of an mRNA encoding GRB14, wherein each strand is about 14 to about 30 nucleotides in length, wherein said dsRNA agent is represented by formula (III):

$$\text{sense: } 5'n_p\text{-}N_a\text{—}(XXX)_i\text{—}N_b\text{—}YYY\text{—}N_b\text{—}(ZZZ)_j\text{—}N_a\text{-}n_q 3'$$

$$\text{antisense: } 3'n_p'\text{—}N_a'\text{—}(X'X'X')_k\text{—}N_b'\text{—}Y'Y'Y'\text{—}N_b'\text{—}(Z'Z'Z')\text{—}N_a'\text{-}n_q' 5' \qquad \text{(III)}$$

wherein:

i, j, k, and l are each independently 0 or 1;

p, p', q, and q' are each independently 0-6;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b'$ independently represents an oligonucleotide sequence comprising 0-10 nucleotides which are either modified or unmodified or combinations thereof, each $n_p$, $n_p'$, $n_q$, and $n_q'$, each of which may or may not be present, independently represents an overhang nucleotide;

XXX, YYY, ZZZ, X'X'X', Y'Y'Y', and Z'Z'Z' each independently represent one motif of three identical modifications on three consecutive nucleotides;

modifications on $N_b$ differ from the modification on Y and modifications on $N_b'$ differ from the modification on Y'; and wherein the sense strand is conjugated to at least one ligand.

In one embodiment, i is 0; j is 0; i is 1; j is 1; both i and j are 0; or both i and j are 1. In another embodiment, k is 0; l is 0; k is 1; l is 1; both k and l are 0; or both k and l are 1.

In one embodiment, XXX is complementary to X'X'X', YYY is complementary to Y'Y'Y', and ZZZ is complementary to Z'Z'Z'.

In one embodiment, the YYY motif occurs at or near the cleavage site of the sense strand, e.g., the Y'Y'Y' motif occurs at the 11, 12 and 13 positions of the antisense strand from the 5'-end.

In one embodiment, formula (III) is represented by formula (IIIa):

sense: $5' n_p\text{-}N_a\text{—}YYY\text{—}N_a\text{-}n_q 3'$ antisense: $3' n_{p'}\text{—}N_{a'}\text{—}Y'Y'Y'\text{—}N_{a'}\text{-}n_{q'} 5'$ (IIIa).

In another embodiment, formula (III) is represented by formula (IIIb):

sense: $5' n_p\text{-}N_a\text{—}YYY\text{—}N_b\text{—}ZZZ\text{—}N_a\text{-}n_q 3'$ antisense: $3' n_{p'}\text{—}N_{a'}\text{—}Y'Y'Y'\text{—}N_{b'}\text{—}Z'Z'Z'\text{—}N_{a'}\text{-}n_{q'} 5'$ (IIIb)

wherein each $N_b$ and $N_b'$ independently represents an oligonucleotide sequence comprising 1-5 modified nucleotides.

In yet another embodiment, formula (III) is represented by formula (IIIc):

sense: $5' n_p\text{-}N_a\text{—}XXX\text{—}N_b\text{—}YYY\text{—}N_a\text{-}n_q 3'$ antisense: $3' n_{p'}\text{—}N_{a'}\text{—}X'X'X'\text{—}N_{b'}\text{—}Y'Y'Y'\text{—}N_{a'}\text{-}n_{q'} 5'$ (IIIc)

wherein each $N_b$ and $N_b'$ independently represents an oligonucleotide sequence comprising 1-5 modified nucleotides.

In another embodiment, formula (III) is represented by formula (IIId):

sense: $5' n_p\text{-}N_a\text{—}XXX\text{—}N_b\text{—}YYY\text{—}N_b\text{—}ZZZ\text{—}N_a\text{-}n_q 3'$ antisense: $3' n_{p'}\text{—}N_{a'}\text{—}X'X'X'\text{—}N_{b'}\text{—}Y'Y'Y'\text{—}N_{b'}\text{—}Z'Z'Z'\text{—}N_{a'}\text{-}n_{q'} 5'$ (IIId)

wherein each $N_b$ and $N_b'$ independently represents an oligonucleotide sequence comprising 1-5 modified nucleotides and each $N_a$ and $N_a'$ independently represents an oligonucleotide sequence comprising 2-10 modified nucleotides.

The region of complementarity may be at least 17 nucleotides in length; 19 to 30 nucleotides in length; 19-25 nucleotides in length; or 21 to 23 nucleotides in length.

Each strand may be no more than 30 nucleotides in length, e.g., each strand is independently 19-30 nucleotides in length.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-O-methyl, 2'-deoxy, 2'-hydroxyl, and combinations thereof.

In one embodiment, the modifications on the nucleotides are 2'-O-methyl or 2'-fluoro modifications.

In one embodiment, the Y' is a 2'-O-methyl or 2'-flouro modified nucleotide.

In one embodiment, at least one strand of the dsRNA agent may comprise a 3' overhang of at least 1 nucleotide; or a 3' overhang of at least 2 nucleotides.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand. In one embodiment, the strand is the antisense strand. In another embodiment, the strand is the sense strand.

In one embodiment, the phosphorothioate or methylphosphonate internucleotide linkage is at the 5'-terminus of one strand. In one embodiment, the strand is the antisense strand. In another embodiment, the strand is the sense strand.

In one embodiment, the strand is the antisense strand. In another embodiment, the strand is the sense strand.

In one embodiment, the phosphorothioate or methylphosphonate internucleotide linkage is at both the 5'- and 3'-terminus of one strand.

In one embodiment, the base pair at the 1 position of the 5'-end of the antisense strand of the duplex is an AU base pair.

In one embodiment, p'>0. In another embodiment, p'=2.

In one embodiment, q'=0, p=0, q=0, and p' overhang nucleotides are complementary to the target mRNA. In another embodiment, q'=0, p=0, q=0, and p' overhang nucleotides are non-complementary to the target mRNA.

In one embodiment, the sense strand has a total of 21 nucleotides and the antisense strand has a total of 23 nucleotides.

In one embodiment, at least one $n_p'$ is linked to a neighboring nucleotide via a phosphorothioate linkage. In another embodiment, wherein all $n_p'$ are linked to neighboring nucleotides via phosphorothioate linkages.

In one embodiment, all of the nucleotides of the sense strand and all of the nucleotides of the antisense strand comprise a modification.

In one embodiment, the ligand is conjugated to the 3' end of the sense strand of the dsRNA agent.

In one embodiment, the ligand is one or more N-acetylgalactosamine (GalNAc) derivatives attached through a monovalent, bivalent, or trivalent branched linker.

In one embodiment, the ligand is

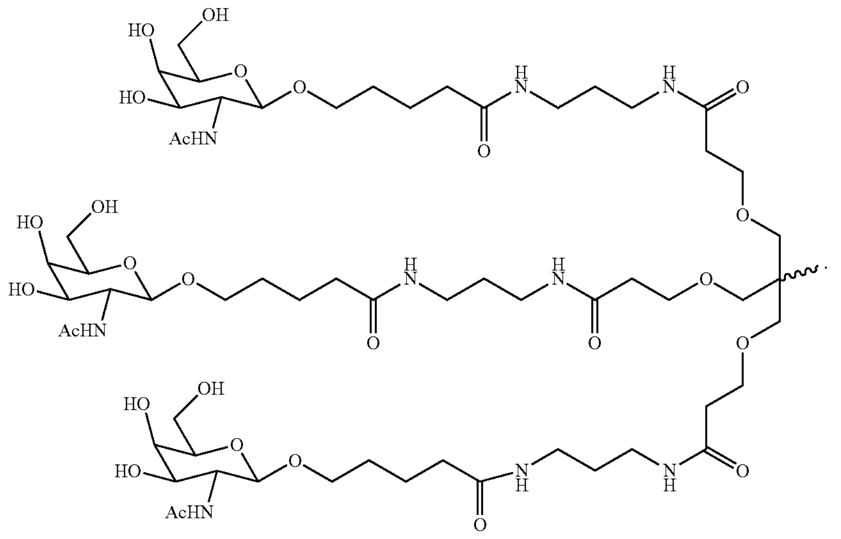

In one embodiment, the dsRNA agent is conjugated to the ligand as shown in the following schematic

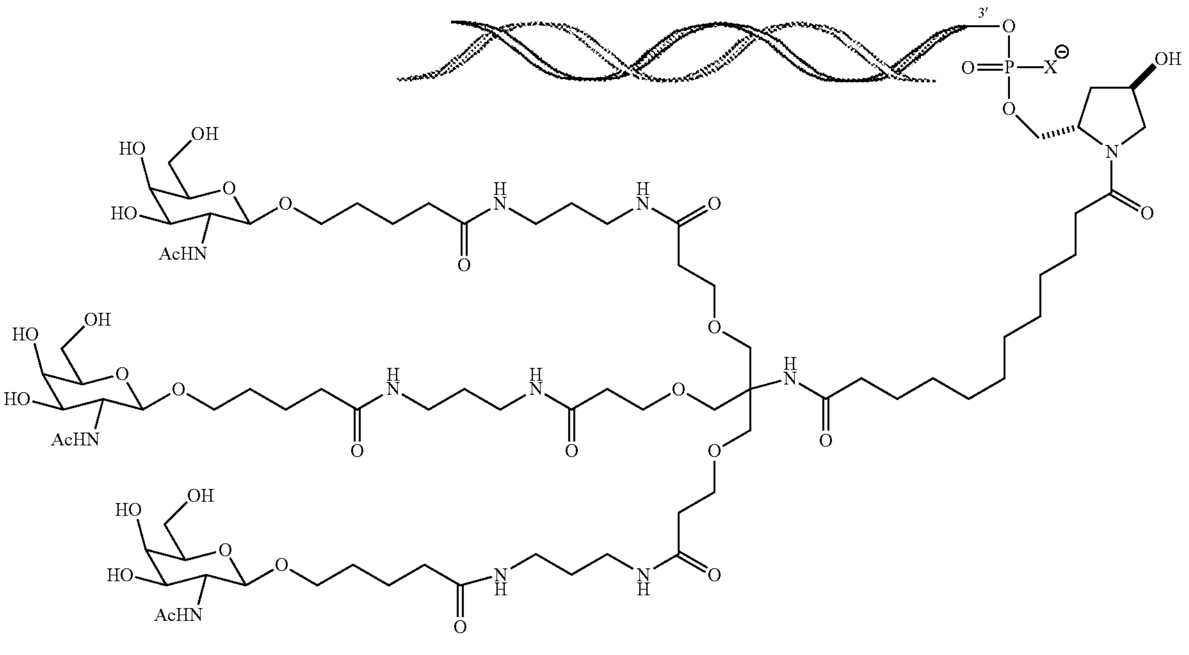

and, wherein X is O or S.

In one embodiment, the X is O.

In one aspect, the present invention provides a double stranded ribonucleic acid (dsRNA) agent for inhibiting the expression of growth factor receptor bound protein 14 (GRB14) in a cell. The dsRNA agent includes a sense strand complementary to an antisense strand, wherein the antisense strand comprises a region complementary to part of an mRNA encoding GRB14, wherein each strand is about 14 to about 30 nucleotides in length, wherein the dsRNA agent is represented by formula (III):

$$\text{sense: } 5'n_p\text{-}N_a\text{—}(XXX)_i\text{—}N_b\text{—}YYY\text{—}N_b\text{—}(ZZZ)_j\text{—}N_a\text{-}n_q3'$$

$$\text{antisense: } 3'n_p'\text{—}N_a'\text{—}(X'X'X')_k\text{—}N_b'\text{—}Y'Y'Y'\text{—}N_b'\text{—}(Z'Z'Z')\text{—}N_a'\text{-}n_q'5' \quad \text{(III)}$$

wherein:

i, j, k, and l are each independently 0 or 1;

p, p', q, and q' are each independently 0-6;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b$' independently represents an oligonucleotide sequence comprising 0-10 nucleotides which are either modified or unmodified or combinations thereof, each $n_p$, $n_p$', $n_q$, and $n_q$', each of which may or may not be present independently represents an overhang nucleotide;

XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b$' differ from the modification on Y'; and wherein the sense strand is conjugated to at least one ligand.

In one aspect, the present invention provides a double stranded ribonucleic acid (dsRNA) agent for inhibiting the expression of growth factor receptor bound protein 14 (GRB14) in a cell. The dsRNA agent includes a sense strand complementary to an antisense strand, wherein the antisense strand comprises a region complementary to part of an mRNA encoding GRB14, wherein each strand is about 14 to about 30 nucleotides in length, wherein the dsRNA agent is represented by formula (III):

sense: 5'$n_p$-$N_a$—$(XXX)_i$—$N_b$—YYY—$N_b$—$(ZZZ)_j$—$N_a$-$n_q$3' antisense: 3'$n_p$'—$N_a$'—$(X'X'X')_k$—$N_b$'—Y'Y'Y'—$N_b$'—$(Z'Z'Z')_l$—$N_a$'-$n_q$'5' (III)

wherein:

i, j, k, and l are each independently 0 or 1;

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence comprising 0-25 nucleotides which are either modified or unmodified or combinations thereof, each sequence comprising at least two differently modified nucleotides;

each $N_b$ and $N_b$' independently represents an oligonucleotide sequence comprising 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b$' differ from the modification on Y'; and wherein the sense strand is conjugated to at least one ligand.

In one aspect, the present invention provides a double stranded ribonucleic acid (dsRNA) agent for inhibiting the expression of growth factor receptor bound protein 14 (GRB14) in a cell. The dsRNA agent includes a sense strand complementary to an antisense strand, wherein the antisense strand comprises a region complementary to part of an mRNA encoding GRB14, wherein each strand is about 14 to about 30 nucleotides in length, wherein the dsRNA agent is represented by formula (III):

sense: 5'$n_p$-$N_a$—$(XXX)_i$—$N_b$—YYY—$N_b$—$(ZZZ)_j$—$N_a$-$n_q$3' antisense: 3'$n_p$'—$N_a$'—$(X'X'X')_k$—$N_b$'—Y'Y'Y'—$N_b$'—$(Z'Z'Z')_l$—$N_a$'-$n_q$'5' (III)

wherein:

i, j, k, and l are each independently 0 or 1;

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence comprising 0-25 nucleotides which are either modified or unmodified or combinations thereof, each sequence comprising at least two differently modified nucleotides;

each $N_b$ and $N_b$' independently represents an oligonucleotide sequence comprising 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b$' differ from the modification on Y'; and wherein the sense strand is conjugated to at least one ligand, wherein the ligand is one or more GalNAc derivatives attached through a monovalent, bivalent, or trivalent branched linker.

In one aspect, the present invention provides a double stranded ribonucleic acid (dsRNA) agent for inhibiting the expression of growth factor receptor bound protein 14 (GRB14) in a cell. The dsRNA agent includes a sense strand complementary to an antisense strand, wherein the antisense strand comprises a region complementary to part of an mRNA encoding GRB14, wherein each strand is about 14 to about 30 nucleotides in length, wherein the dsRNA agent is represented by formula (III):

sense: 5'$n_p$-$N_a$—$(XXX)_i$—$N_b$—YYY—$N_b$—$(ZZZ)_j$—$N_a$-$n_q$3' antisense: 3'$n_p$'—$N_a$'—$(X'X'X')_k$—$N_b$'—Y'Y'Y'—$N_b$'—(Z'Z'Z')—$N_a$'-$n_q$'5' (III)

wherein:

i, j, k, and l are each independently 0 or 1;

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence comprising 0-25 nucleotides which are either modified or unmodified or combinations thereof, each sequence comprising at least two differently modified nucleotides;

each $N_b$ and $N_b$' independently represents an oligonucleotide sequence comprising 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;

modifications on $N_b$ differ from the modification on Y and modifications on $N_b$' differ from the modification on Y';

wherein the sense strand comprises at least one phosphorothioate linkage; and wherein the sense strand is conjugated to at least one ligand, wherein the ligand is one or more GalNAc derivatives attached through a monovalent, bivalent, or trivalent branched linker.

In one aspect, the present invention provides a double stranded ribonucleic acid (dsRNA) agent for inhibiting the expression of growth factor receptor bound protein 14 (GRB14) in a cell. The dsRNA agent includes a sense strand complementary to an antisense strand, wherein the antisense strand comprises a region complementary to part of an mRNA encoding GRB14, wherein each strand is about 14 to about 30 nucleotides in length, wherein the dsRNA agent is represented by formula (III):

sense: 5'$n_p$-$N_a$—YYY—$N_a$-$n_q$3' antisense: 3'$n_p$'—$N_a$'—Y'Y'Y'—$N_a$'-$n_q$'5' (IIIa)

wherein:

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence comprising 0-25 nucleotides which are either modified or unmodified or combinations thereof, each sequence comprising at least two differently modified nucleotides;

YYY and Y'Y'Y' each independently represent one motif of three identical modifications on three consecutive nucleotides, and wherein the modifications are 2'-O-methyl and/or 2'-fluoro modifications;

wherein the sense strand comprises at least one phosphorothioate linkage; and wherein the sense strand is conjugated to at least one ligand, wherein the ligand is one or more GalNAc derivatives attached through a monovalent, bivalent, or trivalent branched linker.

In one aspect, the present invention provides a double stranded ribonucleic acid (dsRNA) agent for inhibiting the expression of growth factor receptor bound protein 14 (GRB14) in a cell. The dsRNA agent includes a sense strand and an antisense strand forming a double stranded region, wherein the sense strand comprises at least 15 contiguous nucleotides differing by no more than 1, 2, or 3 nucleotides from the nucleotide sequence of any one of SEQ ID NOs: 29 and 31, and the antisense strand comprises at least 15 contiguous nucleotides differing by no more than 1, 2, or 3 nucleotides from the nucleotide sequence of any one of SEQ ID NOs: 30 and 32, wherein substantially all of the nucleotides of the sense strand comprise a modification selected from the group consisting of a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from the group consisting of a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a monovalent, bivalent or trivalent branched linker at the 3'-terminus. In some embodiments, the dsRNA agent includes a sense strand and an antisense strand forming a double stranded region, wherein the sense strand comprises at least 15 contiguous nucleotides from the nucleotide sequence of any one of SEQ ID NOs: 29 and 31, and the antisense strand comprises at least 15 contiguous nucleotides from the nucleotide sequence of any one of SEQ ID NOs: 30 and 32, wherein substantially all of the nucleotides of the sense strand comprise a modification selected from the group consisting of a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from the group consisting of a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a monovalent, bivalent or trivalent branched linker at the 3'-terminus.

In one embodiment, all of the nucleotides of the sense strand and all of the nucleotides of the antisense strand are modified nucleotides.

In one embodiment, the region of complementarity comprises any one of the antisense sequences listed in any one of Tables 7-10. In one embodiment, the agent is selected from the group consisting of AD-1399762, AD-1399763, AD-1399764, AD-1399765, AD-1399766, AD-1399767, AD-1399768, AD-1399769, AD-1399770, AD-1399771, AD-1399772, AD-1399773, AD-1399774, AD-1399775, AD-1399776, AD-1399777, AD-1399778, AD-1399779, AD-1399780, AD-1399781, AD-1399782, AD-1399783, AD-1399784, AD-1399785, AD-1399786, AD-1399787, AD-1399788, AD-1399789, AD-1399790, AD-1399791, AD-1399792, AD-1399793, AD-1399794, AD-1399795, AD-1399796, AD-1399797, AD-1399798, AD-1399799, AD-1399800, AD-1399801, AD-1399802, AD-1399803, AD-1399804, AD-1399805, AD-1399806, AD-1399807, AD-1399808, AD-1399809, AD-1399810, AD-1399811, AD-1399812, AD-1399813, AD-1399814, AD-1399815, AD-1399816, AD-1399817, AD-1399818, AD-1399819, AD-1399820, AD-1399821, AD-1399822, AD-1399823, AD-1399824, AD-1399825, AD-1399826, AD-1399827, AD-1399828, AD-1399829, AD-1399830, AD-1399831, AD-1399832, AD-1399833, AD-1399834, AD-1399835, AD-1399836, AD-1399837, AD-1399838, AD-1399839, AD-1399840, AD-1399841, AD-1399842, AD-1399843, AD-1399844, AD-1399845, AD-1399846, AD-1399847, AD-1399848, AD-1399849, AD-1399850, AD-1399851, AD-1399852, AD-1399853, AD-1399854, AD-1399855, AD-1399856, AD-1399857, AD-1399858, AD-1399859, AD-1399860, AD-1399861, AD-1399862, AD-1399863, AD-1399864, AD-1399865, AD-1399866, AD-1399867, AD-1399868, AD-1399869, AD-1399870, AD-1399871, AD-1399872, AD-1399873, AD-1399874, AD-1399875, AD-1399876, AD-1399877, AD-1399878, AD-1399879, AD-1399880, AD-1399881, AD-1399882, AD-1399883, AD-1399884, AD-1399885, AD-1399886, AD-1399887, AD-1399888, AD-1399889, AD-1399890, AD-1399891, AD-1399892, AD-1399893, AD-1399894, AD-1399895, AD-1399896, AD-1589130, AD-1589133, AD-1589138, AD-1589141, AD-1589260, AD-1589263, AD-1589268, AD-1589270, AD-1589289, AD-1589292, AD-1589297, AD-1589302, AD-1589305, AD-1589316, AD-1589330, AD-1589333, AD-1589336, AD-1589341, AD-1589343, AD-1589344, AD-1589346, AD-1589351, AD-1589354, AD-1589365, AD-1589368, AD-1589373, AD-1589376, AD-1589385, AD-1589388, AD-1589393, AD-1589395, AD-1589396, AD-1589398, AD-1589403, AD-1589406, AD-1589471, AD-1589474, AD-1589479, AD-1589481, AD-1589482, AD-1589484, AD-1589489, AD-1589492, AD-1589495, AD-1589500, AD-1589502, AD-1589503, AD-1589505, AD-1589510, AD-1589513, AD-1589518, AD-1589520, AD-1589521, AD-1589523, AD-1589528, AD-1589531, AD-1589625, AD-1589628, AD-1589633, AD-1589636, AD-1589665, AD-1589668, AD-1589673, AD-1589676, AD-1589685, AD-1589688, AD-1589693, AD-1589695, AD-1589696, AD-1589698, AD-1589703, AD-1589705, AD-1589706, AD-1589708, AD-1589713, AD-1589716, AD-1589842, AD-1589845, AD-1589850, AD-1589853, AD-1589902, AD-1589905, AD-1589910, AD-1589913, AD-1589923, AD-1589925, AD-1589926, AD-1589928, AD-1589933, AD-1590015, AD-1590018, AD-1590023, AD-1590026, AD-1590045, AD-1590048, AD-1590053, AD-1590056, AD-1590085, AD-1590088, AD-1590093, AD-1590096, AD-1590145, AD-1590148, AD-1590153, AD-1590155, AD-1590156, AD-1590158, AD-1590163, AD-1590166, AD-1590192, AD-1590195, AD-1590200, AD-1590203, AD-1631258, AD-1631259, AD-1631260, AD-1631261, AD-1631262, AD-1631263, AD-1631264, AD-1631265, AD-1631266, AD-1631267, AD-1631268, AD-1631269, AD-1631270, and AD-1631271.

In one embodiment, the sense strand and the antisense strand comprise nucleotide sequences selected from the group consisting of the nucleotide sequences of any one of the agents listed in any one of Tables 7-10.

The present invention also provides cells, vectors, and pharmaceutical compositions which include any of the dsRNA agents of the invention. The dsRNA agents may be formulated in an unbuffered solution, e.g., saline or water, or in a buffered solution, e.g., a solution comprising acetate, citrate, prolamine, carbonate, or phosphate or any combination thereof. In one embodiment, the buffered solution is phosphate buffered saline (PBS).

In one aspect, the present invention provides a method of inhibiting growth factor receptor bound protein 14 (GRB14) expression in a cell. The method includes contacting the cell with a dsRNA agent or a pharmaceutical composition of the invention, thereby inhibiting expression of GRB14 in the cell.

The cell may be within a subject, such as a human subject.

In one embodiment, the GRB14 expression is inhibited by at least 30%, 40%, 50%, 60%, 70%, 80%, 90%, 95%, or to below the level of detection of GRB14 expression.

In one embodiment, the human subject suffers from a GRB14-associated disease, disorder, or condition. In one embodiment, the GRB14-associated disease, disorder, or condition is diabetes. In one embodiment the diabetes is type 2 diabetes. In another embodiment, the diabetes is type 1 diabetes. In one embodiment, the GRB14-associated disease, disorder, or condition is prediabetes. In one embodiment, the GRB14-associated disease, disorder, or condition is insulin resistance. In one embodiment, the GRB14-associated disease, disorder, or condition is a diabetes-related disease, disorder, or condition. In one embodiment, the GRB14-associated disease, disorder, or condition is obesity, diabetic neuropathy, diabetic nephropathy, diabetic vasculopathy, diabetic retinopathy, hypertension, dyslipidemia, atherosclerosis, coronary heart disease, and stroke.

In one aspect, the present invention provides a method of inhibiting the expression of GRB14 in a subject. The methods include administering to the subject a therapeutically effective amount of a dsRNA agent or a pharmaceutical composition of the invention, thereby inhibiting the expression of GRB14 in the subject. In one embodiment, the subject has a GRB14-associated disease, disorder, or condition. In one embodiment, the GRB14-associated disease, disorder, or condition is diabetes. In one embodiment the diabetes is type 2 diabetes. In another embodiment, the diabetes is type 1 diabetes. In one embodiment, the GRB14-associated disease, disorder, or condition is prediabetes. In one embodiment, the GRB14-associated disease, disorder, or condition is insulin resistance. In one embodiment, the GRB14-associated disease, disorder, or condition is a diabetes-related disease, disorder, or condition. In one embodiment, the GRB14-associated disease, disorder, or condition is obesity, diabetic neuropathy, diabetic nephropathy, diabetic vasculopathy, diabetic retinopathy, hypertension, dyslipidemia, atherosclerosis, coronary heart disease, and stroke.

In another aspect, the present invention provides a method of treating a subject suffering from a GRB14-associated disease, disorder, or condition. The method includes administering to the subject a therapeutically effective amount of a dsRNA agent or a pharmaceutical composition of the invention, thereby treating the subject suffering from a GRB14-associated disease, disorder, or condition. In one embodiment, the GRB14-associated disease, disorder, or condition is diabetes. In one embodiment the diabetes is type 2 diabetes. In another embodiment, the diabetes is type 1 diabetes. In one embodiment, the GRB14-associated disease, disorder, or condition is prediabetes. In one embodiment, the GRB14-associated disease, disorder, or condition is insulin resistance. In one embodiment, the GRB14-associated disease, disorder, or condition is a diabetes-related disease, disorder, or condition. In one embodiment, the GRB14-associated disease, disorder, or condition is obesity, diabetic neuropathy, diabetic nephropathy, diabetic vasculopathy, diabetic retinopathy, hypertension, dyslipidemia, atherosclerosis, coronary heart disease, and stroke.

In another aspect, the present invention provides a method of preventing at least one symptom in a subject having a GRB14-associated disease, disorder, or condition. The method includes administering to the subject a prophylactically effective amount of the agent of a dsRNA agent or a pharmaceutical composition of the invention, thereby preventing at least one symptom in a subject having a GRB14-associated disease, disorder, or condition. In one embodiment, the GRB14-associated disease, disorder, or condition is diabetes. In one embodiment the diabetes is type 2 diabetes. In another embodiment, the diabetes is type 1 diabetes. In one embodiment, the GRB14-associated disease, disorder, or condition is prediabetes. In one embodiment, the GRB14-associated disease, disorder, or condition is insulin resistance. In one embodiment, the GRB14-associated disease, disorder, or condition is a diabetes-related disease, disorder, or condition. In one embodiment, the GRB14-associated disease, disorder, or condition is obesity, diabetic neuropathy, diabetic nephropathy, diabetic vasculopathy, diabetic retinopathy, hypertension, dyslipidemia, atherosclerosis, coronary heart disease, and stroke.

In another aspect, the present invention provides a method of reducing the risk of developing type 2 diabetes in a subject. The method includes administering to the subject a prophylactically effective amount or a prophylactically effective amount of a dsRNA agent or a pharmaceutical composition of the invention, thereby reducing the risk of developing type 2 diabetes in the subject.

In another aspect, the present invention provides a method of increasing insulin sensitivity in a subject. The method includes administering to the subject a therapeutically effective amount of a dsRNA agent or a pharmaceutical composition of the invention, thereby increasing insulin sensitivity in the subject. In one embodiment, the insulin sensitivity is hepatic insulin sensitivity.

In another aspect, the present invention provides a method of reversing type 2 diabetes in a subject. The method includes administering to the subject a therapeutically effective amount of a dsRNA agent or a pharmaceutical composition of the invention, thereby reversing type 2 diabetes in the subject.

In one embodiment, the subject is obese.

In one embodiment, the methods and uses of the invention further include administering an additional therapeutic to the subject.

In one embodiment, the dsRNA agent is administered to the subject at a dose of about 0.01 mg/kg to about 10 mg/kg or about 0.5 mg/kg to about 50 mg/kg.

The agent may be administered to the subject intravenously, intramuscularly, or subcutaneously.

In one embodiment, the agent is administered to the subject subcutaneously.

In one embodiment, the methods and uses of the invention further include determining, the level of GRB14 in the subject.

In one aspect, the present invention provides a double stranded ribonucleic acid (dsRNA) agent for inhibiting expression of growth factor receptor bound protein 14 (GRB14) in a cell, wherein the dsRNA agent comprises a sense strand and an antisense strand forming a double stranded region, wherein the sense strand comprises a nucleotide sequence of any one of the agents in any one of Tables 7-10, and the antisense strand comprises a nucleotide sequence of any one of the agents in any one of Tables 7-10, wherein substantially all of the nucleotide of the sense strand and substantially all of the nucleotides of the antisense strand are modified nucleotides, and wherein the dsRNA agent is conjugated to a ligand.

In one embodiment, the sense strand, the antisense strand, or both the sense strand and the antisense strand is conjugated to one or more lipophilic moieties.

In one embodiment, the lipophilic moiety is conjugated to one or more internal positions in the double stranded region of the dsRNA agent.

In one embodiment, the lipophilic moiety is conjugated via a linker or carrier.

In one embodiment, the lipophilicity of the lipophilic moiety, measured by logKow, exceeds 0.

In one embodiment, the hydrophobicity of the double-stranded RNAi agent, measured by the unbound fraction in a plasma protein binding assay of the double-stranded RNAi agent, exceeds 0.2.

In one embodiment, the plasma protein binding assay is an electrophoretic mobility shift assay using human serum albumin protein.

In one embodiment, one or more lipophilic moieties are conjugated to one or more internal positions on at least one strand, such as via a linker or carrier.

In one embodiment, the internal positions include all positions except the terminal two positions from each end of the at least one strand.

In another embodiment, the internal positions include all positions except the terminal three positions from each end of the at least one strand.

In one embodiment, the internal positions exclude a cleavage site region of the sense strand.

In one embodiment, the internal positions include all positions except positions 9-12, counting from the 5'-end of the sense strand.

In another embodiment, the internal positions include all positions except positions 11-13, counting from the 3'-end of the sense strand.

In one embodiment, the internal positions exclude a cleavage site region of the antisense strand.

In one embodiment, the internal positions include all positions except positions 12-14, counting from the 5'-end of the antisense strand.

In one embodiment, the internal positions include all positions except positions 11-13 on the sense strand, counting from the 3'-end, and positions 12-14 on the antisense strand, counting from the 5'-end.

In one embodiment, the one or more lipophilic moieties are conjugated to one or more of the internal positions selected from the group consisting of positions 4-8 and 13-18 on the sense strand, and positions 6-10 and 15-18 on the antisense strand, counting from the 5'end of each strand.

In another embodiment, the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.

In one embodiment, the internal positions in the double stranded region exclude a cleavage site region of the sense strand.

In one embodiment, the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand.

In one embodiment, the lipophilic moiety is conjugated to position 21, position 20, position 15, position 1, or position 7 of the sense strand.

In another embodiment, the lipophilic moiety is conjugated to position 21, position 20, or position 15 of the sense strand.

In yet another embodiment, the lipophilic moiety is conjugated to position 20 or position 15 of the sense strand.

In one embodiment, the lipophilic moiety is conjugated to position 16 of the antisense strand.

In one embodiment, the lipophilic moiety is an aliphatic, alicyclic, or polyalicyclic compound.

In one embodiment, the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine.

In one embodiment, the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.

In one embodiment, the lipophilic moiety contains a saturated or unsaturated C6-C18 hydrocarbon chain.

In one embodiment, the lipophilic moiety contains a saturated or unsaturated C16 hydrocarbon chain.

In one embodiment, the saturated or unsaturated C16 hydrocarbon chain is conjugated to position 6, counting from the 5'-end of the strand.

In one embodiment, the lipophilic moiety is conjugated via a carrier that replaces one or more nucleotide(s) in the internal position(s) or the double stranded region.

In one embodiment, the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.

In one embodiment, the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction, or carbamate.

In one embodiment, the lipophilic moiety is conjugated to a nucleobase, sugar moiety, or internucleosidic linkage.

In one embodiment, the lipophilic moiety or targeting ligand is conjugated via a bio-cleavable linker selected from the group consisting of DNA, RNA, disulfide, amide, functionalized monosaccharides or oligosaccharides of galactosamine, glucosamine, glucose, galactose, mannose, and combinations thereof.

DETAILED DESCRIPTION OF THE INVENTION

The present invention provides iRNA compositions, which effect the RNA-induced silencing complex (RISC)-mediated cleavage of RNA transcripts of a GRB10 or GRB14 gene. The GRB10 or GRB14 gene may be within a cell, e.g., a cell within a subject, such as a human. The present invention also provides methods of using the iRNA compositions of the invention for inhibiting the expression of a GRB10 or GRB14 gene, and for treating a subject who would benefit from inhibiting or reducing the expression of a GRB10 or GRB14 gene, e.g., a subject suffering or prone to suffering from a GRB10- or GRB14-associated disease disorder, or condition, such as a subject suffering or prone to suffering from type 2 diabetes, type 1 diabetes, prediabetes, insulin resistance, or a diabetes-related disease, disorder, or condition, such as obesity, diabetic neuropathy, diabetic nephropathy, diabetic vasculopathy, diabetic retinopathy, hypertension, dyslipidemia, atherosclerosis, coronary heart disease, stroke, etc.

The iRNAs of the invention targeting GRB10 or GRB14 may include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a GRB10 or GRB14 gene.

In some embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of a GRB10 or GRB14 gene. In some embodiments, such iRNA agents having longer length antisense strands may include a second RNA strand (the sense strand) of 20-60 nucleotides in length wherein the sense and antisense strands form a duplex of 18-30 contiguous nucleotides.

The use of the iRNA agents described herein enables the targeted degradation of mRNAs of a GRB10 or GRB14 gene in mammals.

Very low dosages of the iRNAs, in particular, can specifically and efficiently mediate RNA interference (RNAi), resulting in significant inhibition of expression of a GRB10 or GRB14 gene. Thus, methods and compositions including these iRNAs are useful for treating a subject who would benefit from inhibiting or reducing the expression of a GRB10 or GRB14 gene, e.g., a subject that would benefit from a reduction of inflammation of the liver, e.g., a subject suffering or prone to suffering from a GRB10- or GRB14-associated disease disorder, or condition such as diabetes type 2, diabetes type 1, insulin resistance, or a diabetes-related disease, disorder, or condition, such as obesity, diabetic nephropathy, diabetic neurodpathy, hypertension, dyslipidemia, atherosclerosis, coronary heart disease, stroke, etc.

The following detailed description discloses how to make and use compositions containing iRNAs to inhibit the expression of a GRB10 or GRB14 gene, as well as compositions and methods for treating subjects having diseases and disorders that would benefit from inhibition and/or reduction of the expression of this gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles “a” and “an” are used herein to refer to one or to more than one (i.e., to at least one) of the grammatical object of the article. By way of example, “an element” means one element or more than one element, e.g., a plurality of elements.

The term “including” is used herein to mean, and is used interchangeably with, the phrase “including but not limited to”.

The term “or” is used herein to mean, and is used interchangeably with, the term “and/or,” unless context clearly indicates otherwise.

The term “about” is used herein to mean within the typical ranges of tolerances in the art. For example, “about” can be understood as about 2 standard deviations from the mean. In certain embodiments, about means±10%. In certain embodiments, about means±5%. When about is present before a series of numbers or a range, it is understood that “about” can modify each of the numbers in the series or range.

The term “GRB10,” also known as “growth factor receptor bound protein 10,” “insulin receptor-binding protein Grb-IR,” “GRB-IR,” “Grb-10,” “IRBP,” “MEG1,” “RSS,” refers to the well-known gene encoding a growth factor receptor bound protein 10 protein from any vertebrate or mammalian source, including, but not limited to, human, bovine, chicken, rodent, mouse, rat, porcine, ovine, primate, monkey, and guinea pig, unless specified otherwise.

The term also refers to fragments and variants of native GRB10 that maintain at least one in vivo or in vitro activity of a native GRB10. The term encompasses full-length unprocessed precursor forms of GRB10 as well as mature forms resulting from post-translational cleavage of the signal peptide and forms resulting from proteolytic processing.

The human GRB10 gene has 34 exons. Eight variants of the human GRB10 gene have been identified, transcript variants 1-8. The nucleotide and amino acid sequence of a human GRB10 transcript variant 1 can be found in, for example, GenBank Reference Sequence: NM_001350814.2 (SEQ ID NO: 1; reverse complement, SEQ ID NO: 2); the nucleotide and amino acid sequence of a human GRB10 transcript variant 2 can be found in, for example, GenBank Reference Sequence: NM_001001549.3 (SEQ ID NO: 3; reverse complement, SEQ ID NO: 4); the nucleotide and amino acid sequence of a human GRB10 transcript variant 3 can be found in, for example, GenBank Reference Sequence: NM_001001550.3 (SEQ ID NO: 5; reverse complement, SEQ ID NO: 6); the nucleotide and amino acid sequence of a human GRB10 transcript variant 4 can be found in, for example, GenBank Reference Sequence: NM_001001555.3 (SEQ ID NO: 7; reverse complement, SEQ ID NO: 8); the nucleotide and amino acid sequence of a human GRB10 transcript variant 5 can be found in, for example, GenBank Reference Sequence: NM_001350815.2 (SEQ ID NO: 9; reverse complement, SEQ ID NO: 10); the nucleotide and amino acid sequence of a human GRB10 transcript variant 6 can be found in, for example, GenBank Reference Sequence: NM_001350816.3 (SEQ ID NO: 11; reverse complement, SEQ ID NO: 12); the nucleotide and amino acid sequence of a human GRB10 transcript variant 7 can be found in, for example, GenBank Reference Sequence: NM_001371008.1 (SEQ ID NO: 13; reverse complement, SEQ ID NO: 14); and the nucleotide and amino acid sequence of a human GRB10 transcript variant 8 can be found in, for example, GenBank Reference Sequence: NM_001371009.1 (SEQ ID NO: 15; reverse complement, SEQ ID NO: 16).

The human GRB10 gene is located in the chromosomal region 7p12.1. The nucleotide sequence of the genomic region of human chromosome harboring the GRB10 gene may be found in, for example, the Genome Reference Consortium Human Build 38 (also referred to as Human Genome build 38 or GRCh38) available at GenBank. The nucleotide sequence of the genomic region of human chromosome 7 harboring the GRB10 gene may also be found at, for example, GenBank Accession No. NC_000007.14, corresponding to nucleotides 50,590,068-50,793,453 of human chromosome 7. The nucleotide sequence of the human GRB10 gene may be found in, for example, GenBank Accession No. NG_012305.2, corresponding to nucleotides 5,010-208,395.

There are three variants of the mouse (*Mus musculus*) GRB10 gene; the nucleotide and amino acid sequence of a mouse GRB10, transcript variant 1 can be found in, for example, GenBank Reference Sequence: NM_010345.4 (SEQ ID NO: 17; reverse complement, SEQ ID NO: 18); the nucleotide and amino acid sequence of a mouse GRB10, transcript variant 2 can be found in, for example, GenBank Reference Sequence: NM_001177629.1; (SEQ ID NO: 19; reverse complement, SEQ ID NO: 20); and the nucleotide and amino acid sequence of a mouse GRB10, transcript variant 3 can be found in, for example, GenBank Reference Sequence: NM_001370603.1; (SEQ ID NO: 21; reverse complement, SEQ ID NO: 22). The nucleotide and amino acid sequence of a rat (*Rattus norvegicus*) GRB10 transcript can be found in, for example, GenBank Reference Sequence: NM_001109093.1 (SEQ ID NO: 23; reverse complement, SEQ ID NO: 24). The nucleotide and amino acid sequence of a Rhesus monkey (*Macaca* mulatta) GRB10 transcript can be found in, for example, GenBank Reference Sequence: NM_001257428.1 (SEQ ID NO: 25; reverse complement, SEQ ID NO: 26). The nucleotide and amino acid sequence of a rabbit (*Oryctolagus cuniculus*) GRB10 transcript variant X1 can be found in, for example, GenBank Reference Sequence: XM_017337635.1 (SEQ ID NO: 27; reverse complement, SEQ ID NO: 28).

Additional examples of GRB10 mRNA sequences are readily available using publicly available databases, e.g., GenBank, UniProt, and OMIM. Additional information on GRB10 can be found, for example, at www.ncbi.nlm.nih-.gov/gene/2887. The term GRB10 as used herein also refers to variations of the GRB10 gene including variants provided in the clinical variant database, for example, at www.ncbi.nlm.nih.gov/clinvar/?term=GRB10 [gene].

The term "GRB10" as used herein also refers to a particular polypeptide expressed in a cell by naturally occurring DNA sequence variations of the GRB10 gene, such as a single nucleotide polymorphism in the GRB10 gene. Numerous SNPs within the GRB10 gene have been identified and may be found at, for example, NCBI dbSNP (see, e.g., www.ncbi.nlm.nih.gov/snp).

The term "GRB14," also known as "growth factor receptor bound protein 14," refers to the well-known gene encoding a growth factor receptor bound protein 14 protein from any vertebrate or mammalian source, including, but not limited to, human, bovine, chicken, rodent, mouse, rat, porcine, ovine, primate, monkey, and guinea pig, unless specified otherwise.

The term also refers to fragments and variants of native GRB14 that maintain at least one in vivo or in vitro activity of a native GRB14. The term encompasses full-length unprocessed precursor forms of GRB14 as well as mature forms resulting from post-translational cleavage of the signal peptide and forms resulting from proteolytic processing.

The human GRB14 gene has 18 exons. Two variants of the human GRB14 gene have been identified, transcript variants 1 and 2. The nucleotide and amino acid sequence of a human GRB14 transcript variant 1 can be found in, for example, GenBank Reference Sequence: NM_004490.3 (SEQ ID NO: 29; reverse complement, SEQ ID NO: 30); and the nucleotide and amino acid sequence of a human GRB14 transcript variant 2 can be found in, for example, GenBank Reference Sequence: NM_001303422.2 (SEQ ID NO: 31; reverse complement, SEQ ID NO: 32).

The human GRB14 gene is located in the chromosomal region 2q24.3. The nucleotide sequence of the genomic region of human chromosome harboring the GRB14 gene may be found in, for example, the Genome Reference Consortium Human Build 38 (also referred to as Human Genome build 38 or GRCh38) available at GenBank. The nucleotide sequence of the genomic region of human chromosome 2 harboring the GRB14 gene may also be found at, for example, GenBank Accession No. NC_000002.12, corresponding to nucleotides 164,492,417-164,622,959 of human chromosome 2. The nucleotide sequence of the human GRB14 gene may be found in, for example, GenBank Accession No. NG_052839.1, corresponding to nucleotides 5,369-134,434.

The nucleotide and amino acid sequence of a mouse (*Mus musculus*) GRB14 transcript can be found in, for example, GenBank Reference Sequence: NM_016719.1 (SEQ ID NO: 33; reverse complement, SEQ ID NO: 34). The nucleotide and amino acid sequence of a rat (*Rattus norvegicus*) GRB14 transcript can be found in, for example, GenBank Reference Sequence: NM_031623.1 (SEQ ID NO: 35; reverse complement, SEQ ID NO: 36). There are three predicted transcript variants of the Rhesus monkey (*Macaca mulatta*) GRB14 gene. The nucleotide and amino acid sequence of a Rhesus monkey GRB14 transcript variant 1 can be found in, for example, GenBank Reference Sequence: XM_015110244.2 (SEQ ID NO: 37; reverse complement, SEQ ID NO: 38); the nucleotide and amino acid sequence of a Rhesus monkey GRB14 transcript variant 2 can be found in, for example, GenBank Reference Sequence: XM_028830779.1 (SEQ ID NO: 39; reverse complement, SEQ ID NO: 40); and the nucleotide and amino acid sequence of a Rhesus monkey GRB14 transcript variant 3 can be found in, for example, GenBank Reference Sequence: XM_015110245.2 (SEQ ID NO: 41; reverse complement, SEQ ID NO: 42). There are three predicted transcript variants of the rabbit (Oryctolagus *cuniculus*) GRB14 gene. The nucleotide and amino acid sequence of a rabbit GRB14 transcript variant 1 can be found in, for example, GenBank Reference Sequence: XM_008258679.2 (SEQ ID NO: 43; reverse complement, SEQ ID NO: 44); the nucleotide and amino acid sequence of a rabbit GRB14 transcript variant 2 can be found in, for example, GenBank Reference Sequence: XM_017342897.1 (SEQ ID NO: 45; reverse complement, SEQ ID NO: 46); and the nucleotide and amino acid sequence of a rabbit GRB14 transcript variant 3 can be found in, for example, GenBank Reference Sequence: XM_017342898.1 (SEQ ID NO: 47; reverse complement, SEQ ID NO: 48).

Additional examples of GRB14 mRNA sequences are readily available using publicly available databases, e.g., GenBank, UniProt, and OMIM. Additional information on GRB14 can be found, for example, at www.ncbi.nlm.nih.gov/gene/2888. The term GRB14 as used herein also refers to variations of the GRB14 gene including variants provided in the clinical variant database, for example, at www.ncbi.nlm.nih.gov/clinvar/?term=GRB14 [gene].

The term "GRB14" as used herein also refers to a particular polypeptide expressed in a cell by naturally occurring DNA sequence variations of the GRB14 gene, such as a single nucleotide polymorphism in the GRB14 gene. Numerous SNPs within the GRB14 gene have been identified and may be found at, for example, NCBI dbSNP (see, e.g., www.ncbi.nlm.nih.gov/snp).

Growth factor receptor-bound protein 10 (GRB10) and growth factor receptor-bound protein 14 (GRB14) are proteins belonging to a small family of adapter proteins that further comprises GRB7. These adapter proteins interact with a number of receptor tyrosine kinases and signaling molecules. GRB10 binds activated receptors for insulin, IGF-1, epidermal growth factor, growth hormone, platelet-derived growth factor, as well as the oncogenic tyrosine kinases BCR-Abl, Ret, and c-kit. GRB10 demonstrates higher binding affinity for insulin receptor than IGF-1, although binding is significant for both. GRB10 is also a direct substrate of the Tec tyrosine kinase (Giovonnone, et al. (2003) *J Biol Chem* 278(34):31564-73). GRB14 is believed to have fewer binding partners than GRB10, but binds at least EGFR/PDGFR IR, Tek/Tie2, and FGF receptor (Han, et al. (2001) *Oncogene* 20:6351-6321). No binding of GRB14 to IGFR has been reported, but IGFR was sensitive to inhibition of tyrosine kinase activity by GRB14 in vitro, though less so than IR (Holt et al. (2005) *Biochem. J.* 388:393-406).

The GRB10 gene is imprinted in a highly isoform- and tissue-specific manner in mammals. In mice and humans, the paternal GRB10 allele is expressed in a subset of neurons whereas the maternal allele is expressed in most other adult tissues. GRB10 is involved in growth control, cellular proliferation and apoptosis, and insulin/IGF signaling. GRB10 is involved in social dominance behavior in mice and is critical for the normal behavior of an adult mouse. Overexpression of GRB10 inhibits the PI3K/AKT and MAPK signaling pathways whereas GRB10 deficiency increases insulin-dependent phosphoralyation of proteins within these pathways, including AKT and MAPK1 (Plasschaert, et al. (2015) *Proc Natl Acad Sci USA* 112(22):6841-7). GRB10 significantly inhibits insulin-stimulated tyrosine phosphorylation of the insulin receptor substrate proteins IRS-1 and IRS-2, and delays signaling to AKT (Wick, et al. (2003) *J Biol Chem* 278(10):8460-7). Reduced GRB10 expression is associated with neonatal and postnatal overgrowth, particularly in the liver where increased glycogen deposition has been observed (Charalambous, et al. (2003) *Proc Natl Acad Sci USA* 100(14):8292-7).

The GRB14 gene is not imprinted. GRB14 is also a major negative regulator of insulin and IGF-1 metabolic pathways, whereas GRB7 regulates focal adhesion kinase (FAK)-mediated cell migration. GRB7/10/14 are most abundantly expressed in the pancreas, with GRB10/14 having relatively broad expression profiles (Han, et al. (2001) *Oncogene* 20:6351-6321). GRB10/14 mRNA and protein are expressed strongly in skeletal muscle and white adipose tissue, two major insulin target tissues, as well as heart and kidney. Strong GRB10 expression is also found in pancreatic islets, while strong GRB14 expression is also found in the liver and in retinal rod photoreceptor cells (Desbuquois, et al. (2013) *FEBS J* 280(3):794-816). GRB10 is found in both cytoplasm and localized to membranes, such as mitochondrial membranes.

Insulin is a major hormonal regulator of glucose and lipid homeostasis, particularly in the target tissues of muscle, fat, and liver. GRB10 expression is believed to play roles in insulin recognition, production, and secretion. GRB10 has been found to be a negative regulator of insulin signaling, leading to reduced insulin signaling and action, and GRB10 expression is associated with increased insulin and IGF sensitivity. GRB10 overexpression inhibits downstream events of insulin receptor signalling, including glycogen synthase activity and glucose uptake. Disruption of GRB10 expression results in increased insulin signaling in muscle and adipose tissues, as well as enhanced muscle insulin sensitivity. GRB10 disruption in mice has been shown to increase insulin sensitivity in peripheral tissues such as fat and skeletal muscle, but not necessarily in liver. (Wang, et al. (2007) *Mol Cell Biol* (18):6497-505; Plasschaert, et al. (2015) *Proc Natl Acad Sci USA* 112(22):6841-7). GRB10 gene deletion within the mouse pancreas has been shown to increase insulin production, increase insulin secretion, increase insulin content, lead to enhanced insulin and IGF-1 signalling, increase R-cell mass, improve glucose tolerance, and protect from streptozotocin-induced β-cell apoptosis and body weight loss (Zhang, et al. (2012) *Diabetes* 61(12):3189-98). Direct injection of GRB10 shRNA into the pancreas of mice, however, induced apoptosis of β-cells and particulary α-cells, resulting in decreased fasting plasma glucagon and improved glucose tolerance, despite reduced insulin secretion (Doiron, et al. *Diabetologia* 55(3):719-28). GRB10 knockdown in human pancreatic islets has shown reduced insulin and glucagon secretion. Abundant GRB10 expression has been found in embryonic mouse liver, but not in adult mouse liver, and GRB10 deletion did not affect insulin-mediated suppression of hepatic glucose production in mice (Wang, et al. (2007) *Mol Cell Biol* (18):6497-505). Expression of GRB10 in adult mouse liver has been found to be relatively minimal compared to other tissues, such as the pancrease (id.; Zhang, et al. (2012) *Diabetes* 61(12): 3189-98; Desbuquois, et al. (2013) *FEBS J* 280(3):794-816; but cf, Plasschaert, et al. (2015) *Proc Natl Acad Sci USA* 112(22):6841-7). GRB10 is elevated in the kidneys of diabetic mice (Yang, et al. (2016) *PLoS One* 11(3): e0151857GRB10 is elevated in the kidneys of diabetic mice (Yang, et al. (2016) *PLoS One* 11(3):e0151857). RNAi suppression of GRB10 in cell lines showed stable insulin receptor mRNA levels but decreased insulin receptor protein levels, suggesting GRB10 may play a role in ubiquitination-driven degradation of insulin receptor. GRB10 deficiency also protected against insulin receptor reduction induced by prolonged insulin treatment (Ramos, et al. (2006) *Am J Physiol Endocrinol Metab.* 290(6):E1262-6). GRB10 has been shown to play a critical role in regulating diabetes-associated cognitive impairment. Increased GRB10 expression has been observed in the hippocampus of rats with diabetic encephalopathy (Xie, et al. (2014) *PLoS One* 9(9): e108559).

Overexpression of GRB14 blocks the interaction of PTP-1B with the insulin receptor, shielding it from dephosphorylation and at the same time inhibits Akt/PKB and ERK1/2 activation. Furthermore, in Grb14-deficient mice, insulin receptor tyrosine phosphorylation in the liver is decreased, and insulin activation of IRS and Akt/PKB is augmented (Dufresne et al. (2005) *Endocrinology* 146(10):4399-4409). Overexpression of GRB14 in Chinese hamster ovary cells inhibited insulin-stimulated DNA and glycogen synthesis. Like with GRB10, GRB14 also inhibited IR substrate phosphorylation in vitro (Deng et al. (2003) *J Biol Chem* 278 (41):39311-22). Targeted deletion of the GRB14 gene has been shown to improve insulin sensitivity and glucose homeostasis, suggesting GRB14 negatively regulates insulin signaling and action (Wang, et al. (2007)*Mol Cell Biol* (18):6497-505). Disruption of the GRB14 gene in mice results in a slight decrease in body mass and liver mass, an increase in heart mass, and an improved in vivo glucose tolerance and insulin sensitivity. It also enhances insulin-induced stimulation of glucose transport in skeletal muscle, as well as glycogen synthesis in liver and muscle (Desbuquois, et al. (2013) *FEBS J* 280(3):794-816). GRB14 mRNA and protein expression were found to be increased by 75-100% in adipose tissue, but not in liver, in two rodent models of type 2 diabetes, and mRNA expression was increased by 43% in subcutaneous adipose tissue, but was not significantly altered in skeletal muscle, of human type 2 diabetics (Holt et al. (2005) *Biochem. J.* 388:393-406).

Removal of either GRB10 or GRB14 decreases receptor phosphorylation of insulin receptor (IR) and IGF-I receptor, presumably due to increased phosphatase access, and is coupled with enhanced downstream signaling. However, while endogenous GRB10 and GRB14 both appear to inhibit receptor tyrosine kinase signaling, the phenotypes of GRB10 and GRB14 knockout mice are distinct, indicating that the two molecules have unique functional properties despite their structural similarities. (Dufresne et al. (2005) *Endocrinology* 146(10):4399-4409). Dual ablation of GRB10/14 has no additive effects on insulin signaling and body composition (Zhang, et al. (2012) *Diabetes* 61(12): 3189-98). GRB10/14 exhibit similar, but non-identical, tissue expression patterns, with insulin target tissues prominent for both proteins. GRB14 is believed to be more abundant than GRB10 in adult liver, whereas GRB10 may be more abundant than GRB14 in skeletal muscle, and perhaps also in adipose tissue (Holt et al. (2005) *Biochem. J.* 388:393-406). Differential levels of tissues expression of GRB10/14 may suggest that these proteins regulate insulin signaling and action in tissue specific manners. Since disruption of GRB10 has no effect on either GRB7 or GRB14 expression, the increase in muscle insulin sensitivity observed by disrupting GRB10 cannot be explained by compensatory changes in the expression levels of the other two family members (Wang, et al. (2007) *Mol Cell Biol* (18):6497-505). Variants of GRB10 and GRB14 have been associated with obesity and/or insulin resistance. A genome-wide association study (GWAS) found that variants in GRB10 were associated with reduced glucose-stimulated insulin secretion and increased risk of type 2 diabetes if inherited from the father, but reduced fasting glucose when inherited from the mother. (Prokopenko, et al. (2014) *PLoS Genet* 10(4): e1004235). A number of other studies have examined the association of GRB10 and/or GRB14 single nucleotide polymorphisms with type 2 diabetes and/or associated metabolic profiles, each of which is hereby incorporated by reference in its entirety (Di Paula, et al., (2010) *J. Intern. Med.* 267(1):132-133; Di Paula, et al., (2006) *Diabetes Care* 29(5):1181-1182; Manning, et al. (2013) *Nat. Genet.* 44(6): 659-669; Rampersaud, et al. (2007) *Diabetes* 56:3053-3062; Scott, et al. (2012) *Nat. Genet.* 44(9):991-1005; Kooner et al. (2013) *Nat Genet.* 43(10):984-989).

Each protein of the GRB7/10/14 family comprises an N-terminal proline-rich region, a Ras-associating (RA) domain, a pleckstrin homology (PH) domain, a C-terminal Src homology 2 (SH2) domain, and a conserved region referred to as the BPS domain (named for being between the PH and SH2 domains) or the phosphorylated insulin receptor-interacting region (PIR) that is unique to the family. GRB10 binds to phosphotyrosine residues in the kinase domain of insulin receptors via its SH2 and BPS domains in response to insulin stimulation. GRB7/10/14 family members share high sequence identity (approximately 60-70%) in the SH2 domain and a smaller sequence identify with members of the SH2B family of adapter proteins (approximately 25-30%). GRB10 proteins homodimerize via their RA/PH and SH2 domains to form oligomers in solution and cells (GRB10γ) (Desbuquois, et al. (2013) *FEBS J* 280(3): 794-816).

GRB10 insulin regulation activity may be modulated by the interaction of the proline motif binding proteins GRB10-interacting GYF proteins 1 and 2 (GIGYF1/2) with the N terminus of GRB10. Studies have shown GIGYF1 becomes linked to activated IGF-1 receptors via the GRB10 adapter and, when over expressed, can augment IGF-1 signaling. GIGYF1 and GIGYF2 share a 17 amino acid GYF motif that mediates their binding to the proline-rich region in GRB10. GIGYF1 mRNA is most abundant in brain, spleen, lung, and kidney, whereas GIGYF2 has highest abundance in heart and liver. GIGYF1 and GIGYF2 have broad tissue expression in the mouse, generally being abundantly expressed in the same tissues as GRB10, except for skeletal muscle in which GRB10 expression is abundant but not GIGYF1 or GIGYF2 expression (Giovonnone, et al. (2003) *J Biol Chem* 278(34):31564-73). GIGYF2 gene disruption leads to neurodegeneration, and GIGYF2 and GRB10 may act cooperatively in regulating IGF1R signaling (Xie, et al. (2014) *PLoS One* 9(9):e108559). Transfection of cells with GRB10-binding fragments of GIGYF1 lead to greater activation of both the insulin and IGF-1 receptors (Giovonnone, et al. (2003) *J Biol Chem* 278(34):31564-73). According to some aspects, the expression of GIGYF1 and/or GIGYF2 in a cell may be modulated. The modulation of GIGYF1 and/or GIGYF2 may be used to target the same pathways targeted by dsRNAs of the present invention any may be used to treat or supplement treatment of a GRB10- or GRB14-associated disease. dsRNA agents for inhibiting the expression of GIGYF1 and/or GIGYF2 in a cell may be used to modulate the pathways described herein.

As used herein, "target sequence" refers to a contiguous portion of the nucleotide sequence of an mRNA molecule formed during the transcription of a GRB10 or GRB14 gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a GRB10 or GRB14 gene.

The target sequence of a GRB10 or GRB14 gene may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 2). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of the GRB10 or GRB14 gene in a cell, e.g., a cell within a subject, such as a mammalian subject.

In one embodiment, an RNAi agent of the invention includes a single stranded RNA that interacts with a target RNA sequence, e.g., a GRB10 or GRB14 target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (sssiRNA) generated within a cell and which promotes the formation of a RISC complex to effect silencing of the target gene, i.e., a GRB10 or GRB14 gene. Accordingly, the term "siRNA" is also used herein to refer to an RNAi as described above.

In another embodiment, the RNAi agent may be a single-stranded RNAi agent that is introduced into a cell or organism to inhibit a target mRNA. Single-stranded RNAi agents (ssRNAi) bind to the RISC endonuclease, Argonaute 2, which then cleaves the target mRNA. The single-stranded siRNAs are generally 15-30 nucleotides and are chemically modified. The design and testing of single-stranded RNAi agents are described in U.S. Pat. No. 8,101,348 and in Lima et al., (2012) *Cell* 150: 883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, an "iRNA" for use in the compositions and methods of the invention is a double-stranded RNA and is referred to herein as a "double stranded RNAi agent," "double-stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a GRB10 or GRB14 gene. In some embodiments of the invention, a double-stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, and/or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In one embodiment, an RNAi agent of the invention is a dsRNA, each strand of which comprises less than 30 nucleotides, e.g., 17-27, 19-27, 17-25, 19-25, or 19-23, that interacts with a target RNA sequence, e.g., a GRB10 or GRB14 target mRNA sequence, to direct the cleavage of the target RNA. In another embodiment, an RNAi agent of the invention is a dsRNA, each strand of which comprises 19-23 nucleotides, that interacts with a target RNA sequence, e.g., a GRB10 or GRB14 target mRNA sequence, to direct the cleavage of the target RNA. In one embodiment, the sense strand is 21 nucleotides in length. In another embodiment, the antisense strand is 23 nucleotides in length.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

In certain embodiments, the overhang on the sense strand or the antisense strand, or both, can include extended lengths longer than 10 nucleotides, e.g., 10-30 nucleotides, 10-25 nucleotides, 10-20 nucleotides or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the extended overhang is replaced with a nucleoside thiophosphate.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

The term "antisense strand" or "guide strand" refers to the strand of an iRNA, e.g., a dsRNA, which includes a region that is substantially complementary to a target sequence, e.g., a GRB10 or GRB14 mRNA.

As used herein, the term "region of complementarity" refers to the region on the antisense strand that is substantially complementary to a sequence, for example a target sequence, e.g., a GRB10 or GRB14 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- and/or 3'-terminus of the iRNA.

The term "sense strand" or "passenger strand" as used herein, refers to the strand of an iRNA that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding GRB10 or GRB14). For example, a polynucleotide is complementary to at least a part of a GRB10 or GRB14 mRNA if the sequence is substantially complementary to a non-interrupted portion of an mRNA encoding GRB10 or GRB14.

Accordingly, in some embodiments, the antisense strand polynucleotides disclosed herein are fully complementary to the target GRB10 sequence. In other embodiments, the antisense strand polynucleotides disclosed herein are substantially complementary to the target GRB10 sequence and comprise a contiguous nucleotide sequence which is at least about 80% complementary over its entire length to the equivalent region of the nucleotide sequence of SEQ ID NO: 1, 3, 5, 7, 9, 11, 13, or 15, or a fragment of SEQ ID NO: 1, 3, 5, 7, 9, 11, 13, or 15, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target GRB10 sequence, and wherein the sense strand polynucleotide comprises a contiguous nucleotide sequence which is at least about 80% complementary over its entire length to the equivalent region of the nucleotide sequence of SEQ ID NO: 2, 4, 6, 8, 10, 12, 14, or 16, or a fragment of any one of SEQ ID NO: 2, 4, 6, 8, 10, 12, 14, or 16, such as about 85%, about 86%, about 87%, about 88%, about 89%, about 90%, about % 91%, about 92%, about 93%, about 94%, about 95%, about 96%, about 97%, about 98%, or about 99% complementary.

In some embodiments, the antisense strand polynucleotides disclosed herein are fully complementary to the target GRB14 sequence. In other embodiments, the antisense strand polynucleotides disclosed herein are substantially complementary to the target GRB14 sequence and comprise a contiguous nucleotide sequence which is at least about 80% complementary over its entire length to the equivalent region of the nucleotide sequence of SEQ ID NO: 29 or 31, or a fragment of SEQ ID NO: 29 or 31, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target GRB14 sequence, and wherein the sense strand polynucleotide comprises a contiguous nucleotide sequence which is at least about 80% complementary over its entire length to the equivalent region of the nucleotide sequence of SEQ ID NO: 30 or 32, or a fragment of any one of SEQ ID NO: 30 or 32, such as about 85%, about 86%, about 87%, about 88%, about 89%, about 90%, about % 91%, about 92%, about 93%, about 94%, about 95%, about 96%, about 97%, about 98%, or about 99% complementary.

In some embodiments, an iRNA of the invention includes an antisense strand that is substantially complementary to the target GRB10 sequence and comprises a contiguous nucleotide sequence which is at least about 80% complementary over its entire length to the equivalent region of the nucleotide sequence of any one of the sense strands in any one of Tables 3-6, or a fragment of any one of the sense strands in any one of Tables 3-6, such as about 85%, 86%, 87%, 88%, 89%, 90%, 91%, 92%, 93%, 94%, 95%, 96%, 97%, 98%, or 99% complementary, or 100% complementary.

In some embodiments, an iRNA of the invention includes an antisense strand that is substantially complementary to the target GRB14 sequence and comprises a contiguous nucleotide sequence which is at least about 80% complementary over its entire length to the equivalent region of the nucleotide sequence of any one of the sense strands in any one of Tables 7-10, or a fragment of any one of the sense strands in any one of Tables 7-10, such as about 85%, 86%, 87%, 88%, 89%, 90%, 91%, 92%, 93%, 94%, 95%, 96%, 97%, 98%, or 99% complementary, or 100% complementary.

The term "inhibiting," as used herein, is used interchangeably with "reducing," "silencing," "downregulating," "suppressing" and other similar terms, and includes any level of inhibition.

The phrase "inhibiting expression of a GRB10 gene" or "inhibiting expression of a GRB14 gene," as used herein, includes inhibition of expression of any GRB10 or GRB14 gene (such as, e.g., a mouse GRB10 or GRB14 gene, a rat GRB10 or GRB14 gene, a monkey GRB10 or GRB14 gene, or a human GRB10 or GRB14 gene) as well as variants or mutants of a GRB10 or GRB14 gene that encode a GRB10 or GRB14 protein, respectively.

"Inhibiting expression of a GRB10 or GRB14 gene" includes any level of inhibition of a GRB10 or GRB14 gene, e.g., at least partial suppression of the expression of a GRB10 or GRB14 gene, such as an inhibition by at least about 20%. In certain embodiments, inhibition is by at least about 25%, at least about 30%, at least about 35%,at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

The expression of a GRB10 or GRB14 gene may be assessed based on the level of any variable associated with GRB10 or GRB14 gene expression, e.g., GRB10 or GRB14 mRNA level or GRB10 or GRB14 protein level. The expression of a GRB10 or GRB14 gene may also be assessed indirectly based on, for example, the enzymatic activity of GRB10 or GRB14 in a tissue sample, such as a liver sample. Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In one embodiment, at least partial suppression of the expression of a GRB10 or GRB14 gene, is assessed by a reduction of the amount of GRB10 or GRB14 mRNA which can be isolated from, or detected, in a first cell or group of cells in which a GRB10 or GRB14 gene is transcribed and which has or have been treated such that the expression of a GRB10 or GRB14 gene is inhibited, as compared to a second cell or group of cells substantially identical to the first cell or group of cells but which has or have not been so treated (control cells).

The degree of inhibition may be expressed in terms of:

$$(m\text{RNA in control cells})-(m\text{RNA in treated cells})/(m\text{RNA in control cells})\cdot 100\%$$

The phrase "contacting a cell with an RNAi agent," such as a dsRNA, as used herein, includes contacting a cell by any possible means. Contacting a cell with an RNAi agent includes contacting a cell in vitro with the iRNA or contacting a cell in vivo with the iRNA. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the bloodstream or the subcutaneous space, such that the agent will subsequently reach the tissue where the cell to be contacted is located. For example, the RNAi agent may contain and/or be coupled to a ligand, e.g., GalNAc3, that directs the RNAi agent to a site of interest, e.g., the liver. Combinations of in vitro and in vivo methods of contacting are also possible. For example, a cell may also be contacted in vitro with an RNAi agent and subsequently transplanted into a subject.

In one embodiment, contacting a cell with an iRNA includes "introducing" or "delivering the iRNA into the cell" by facilitating or effecting uptake or absorption into the cell. Absorption or uptake of an iRNA can occur through unaided diffusive or active cellular processes, or by auxiliary agents or devices. Introducing an iRNA into a cell may be in vitro and/or in vivo. For example, for in vivo introduction, iRNA can be injected into a tissue site or administered systemically. In vivo delivery can also be done by a beta-glucan delivery system, such as those described in U.S. Pat. Nos. 5,032,401 and 5,607,677, and U.S. Publication No. 2005/0281781, the entire contents of which are hereby incorporated herein by reference. In vitro introduction into a cell includes methods known in the art such as electroporation and lipofection. Further approaches are described herein below and/or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose).

In an embodiment, the subject is a human, such as a human being treated or assessed for a disease, disorder or condition that would benefit from reduction in GRB10 or GRB14 expression; a human at risk for a disease, disorder or condition that would benefit from reduction in GRB10 or GRB14 expression; a human having a disease, disorder or condition that would benefit from reduction in GRB10 or GRB14 expression; and/or human being treated for a disease, disorder or condition that would benefit from reduction in GRB10 or GRB14 expression as described herein.

In another embodiment, the subject is homozygous for the GRB10 gene. Each allele of the gene may encode a functional GRB10 protein. In yet another embodiment, the subject is heterozygous for the GRB10 gene. The subject may have an allele encoding a functional GRB10 protein and an allele encoding a loss of function variant of GRB10. In some embodiments, the subject has a maternally inherited allele encoding a functional GRB10 protein. In some embodiments, the subject has a maternally inherited allele associated with an increased risk of diabetes. In some embodiments, the subject has an allele encoding the GRB10 rs4947710 variant. The allele may be maternally inherited. In some embodiments, the subject has an allele encoding the GRB10 rs2237457 variant. The allele may be maternally inherited. In some embodiments, the subject has an allele encoding the GRB10 rs933360 variant. The allele may be paternally inherited. In some embodiments, the subject has an allele encoding the GRB10 rs6943153 variant. The allele may be maternally inherited.

In another embodiment, the subject is homozygous for the GRB14 gene. Each allele of the gene may encode a functional GRB14 protein. In yet another embodiment, the subject is heterozygous for the GRB14 gene. The subject may have an allele encoding a functional GRB14 protein and an allele encoding a loss of function variant of GRB14. In some embodiments, the subject has an allele encoding the rs3923113 variant. In some embodiments, the subject has an allele encoding the rs10195252 variant.

In some embodiments, the subject has a GIGYF1 loss of function allele. In some embodiments, the subject has a GIGYF1 rs221797 variant (e.g., rs221797:A). In some embodiments, the subject has a GIGYF1 rs117231629 variant. In some embodiments, the subject has a GIGYF2 loss of function allele. In some embodiments, the subject has a GIGYF2 rs1801251 variant (e.g., rs1801251:A).

As used herein, the terms "treating" or "treatment" refer to a beneficial or desired result including, but not limited to, alleviation or amelioration of one or more symptoms associated with GRB10 or GRB14 gene expression and/or GRB10 or GRB14 protein production. In some embodiments, symptoms associated with GRB10 or GRB14 gene expression and/or GRB10 or GRB14 protein production may be symptoms of a disease or disorder in which the pathology or cause is independent of GRB10 or GRB14 expression and/or GRB10 or GRB14 protein production, but which may nonetheless be compensated for/treated for/counteracted by inhibiting GRB10 or GRB14 gene expression and/or GRB10 or GRB14 protein production, e.g., a GRB10- or GRB14-associated disease, such as type 2 diabetes, type 1 diabetes, prediabetes, insulin resistance, or a diabetes-related disease, disorder, or condition, such as obesity, diabetic neuropathy, diabetic nephropathy, diabetic vasculopathy, diabetic retinopathy, hypertension, dyslipidemia, atherosclerosis, coronary heart disease, stroke, etc. "Treatment" can also mean prolonging survival as compared to expected survival in the absence of treatment.

The term "lower" in the context of a GRB10 or GRB14-associated disease refers to a statistically significant decrease in such level. The decrease can be, for example, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more. In certain embodiments, a decrease is at least 20%. "Lower" in the context of the level of GRB10 or GRB14 in a subject is preferably down to a level accepted as within the range of normal for an individual without such disorder.

As used herein, "prevention" or "preventing," when used in reference to a disease, disorder or condition thereof, that would benefit from a reduction in expression of a GRB10 or GRB14 gene, refers to a reduction in the likelihood that a subject will develop a symptom associated with such disease, disorder, or condition, e.g., a symptom of GRB10 or GRB14 gene expression or overexpression, such as insulin resistance. The failure to develop a disease, disorder or condition, or the reduction in the development of a symptom associated with such a disease, disorder or condition (e.g., by at least about 10% on a clinically accepted scale for that disease or disorder), or the exhibition of delayed symptoms (e.g., by days, weeks, months or years) is considered effective prevention.

As used herein, the terms "GRB10-associated disease" and "GRB14-associated disease" are diseases or disorders that are caused by, or associated with, GRB10 or GRB14 gene expression, respectively, or by GRB10 or GRB14 protein production, respectively. The terms "GRB10-associated disease" and "GRB14-associated disease" include a disease, disorder or condition that would benefit from a decrease in the gene expression or protein activity of GRB10 or GRB14, respectively. For instance, a "GRB10- or GRB14-associated disease" includes a disease or disorder which does not arise as a result of the expression of a GRB10 or GRB14 gene and/or production of a GRB10 or GRB14 protein, but in which the reduced expression of a GRB10 or GRB14 gene and/or production of a GRB10 or GRB14 protein may nonetheless alleviate the symptoms of or counteract or compensate for the adverse physiological effects of the disease or disorder. A subject having or being at risk for a GRB10- or GRB14-associated disease or disorder may include a subject expressing a wildtype GRB10 or GRB14 gene and/or otherwise exhibiting normal/healthy levels of expression of the GRB10 or GRB14 gene and levels of GRB10 or GRB14 protein production.

In one embodiment, a "GRB10- or GRB14-associated disease" is type 2 diabetes. In one embodiment, a "GRB10- or GRB14-associated disease" is type 1 diabetes. In one embodiment, a "GRB10- or GRB14-associated disease" is prediabetes. In one embodiment, a "GRB10- or GRB14-associated disease" is insulin resistance. In one embodiment, a "GRB10- or GRB14-associated disease" is a diabetes-related complication, such as obesity, diabetic neuropathy, diabetic nephropathy, diabetic vasculopathy, diabetic retinopathy, hypertension, dyslipidemia, atherosclerosis, coronary heart disease, stroke, etc.

"Therapeutically effective amount," as used herein, is intended to include the amount of an RNAi agent that, when administered to a subject having a GRB10- or GRB14-associated disease, disorder, or condition, is sufficient to effective treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an iRNA that, when administered to a subject having a GRB10 or GRB14-associated disease, disorder, or condition, is sufficient to prevent or ameliorate the disease or one or more symptoms of the disease. Ameliorating the disease includes slowing the course of the disease or reducing the severity of later-developing disease. The "prophylactically effective amount" may vary depending on the iRNA, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired local or systemic effect at a reasonable benefit/risk ratio applicable to any treatment. iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, and/or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to blood or plasma drawn from the subject.

II. iRNAs of the Invention

Described herein are iRNAs which inhibit the expression of a target gene. In one embodiment, the iRNAs inhibit the expression of a GRB10 or GRB14 gene. In one embodiment, the iRNA agent includes double stranded ribonucleic acid (dsRNA) molecules for inhibiting the expression of a GRB10 or GRB14 gene in a cell, such as a liver cell, such as a liver cell within a subject, e.g., a mammal, such as a human with type 2 diabetes, type 1 diabetes, prediabetes, or insulin resistance.

The dsRNA includes an antisense strand having a region of complementarity which is complementary to at least a part of an mRNA formed in the expression of a GRB10 or GRB14 gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the target gene, the iRNA inhibits the expression of the target gene (e.g., a human, a primate, a non-primate, or a bird target gene) by at least about 10% as assayed by, for example, a PCR or branched DNA (bDNA)-based method, or by a protein-based method, such as by immunofluorescence analysis, using, for example, Western Blotting or flow cytometric techniques.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a GRB10 or GRB14 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the sense and antisense strands of the dsRNA are each independently about 15 to about 30 nucleotides in length, or about 25 to about 30 nucleotides in length, e.g., each strand is independently between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In some embodiments, the dsRNA is between about 15 and about 23 nucleotides in length, or between about 25 and about 30 nucleotides in length. In general, the dsRNA is long enough to serve as a substrate for the Dicer enzyme. For example, it is well known in the art that dsRNAs longer than about 21-23 nucleotides can serve as substrates for Dicer. As the ordinarily skilled person will also recognize, the region of an RNA targeted for cleavage will most often be part of a larger RNA molecule, often an mRNA molecule. Where relevant, a “part” of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target GRB10 or GRB14 expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

iRNA compounds of the invention may be prepared using a two-step procedure. First, the individual strands of the double-stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

In one aspect, a dsRNA of the invention includes at least two nucleotide sequences, a sense sequence and an anti-sense sequence. The sense strand sequence is selected from the group of sequences provided in any one of Tables 3-6, and the corresponding nucleotide sequence of the antisense strand of the sense strand is selected from the group of sequences of any one of Tables 3-6. In this aspect, one of the two sequences is complementary to the other of the two sequences, with one of the sequences being substantially complementary to a sequence of an mRNA generated in the expression of a GRB10 gene. As such, in this aspect, a dsRNA will include two oligonucleotides, where one oligonucleotide is described as the sense strand (passenger strand) in any one of Tables 3-6, and the second oligonucleotide is described as the corresponding antisense strand (guide strand) of the sense strand in any one of Tables 3-6. In one embodiment, the substantially complementary sequences of the dsRNA are contained on separate oligonucleotides. In another embodiment, the substantially complementary sequences of the dsRNA are contained on a single oligonucleotide.

In one aspect, a dsRNA of the invention includes at least two nucleotide sequences, a sense sequence and an anti-sense sequence. The sense strand sequence is selected from the group of sequences provided in any one of Tables 7-10, and the corresponding nucleotide sequence of the antisense strand of the sense strand is selected from the group of sequences of any one Tables 7-10. In this aspect, one of the two sequences is complementary to the other of the two sequences, with one of the sequences being substantially complementary to a sequence of an mRNA generated in the expression of a GRB14 gene. As such, in this aspect, a dsRNA will include two oligonucleotides, where one oligonucleotide is described as the sense strand (passenger strand) in any one of Tables 7-10, and the second oligonucleotide is described as the corresponding antisense strand (guide strand) of the sense strand in any one of Tables 7-10. In one embodiment, the substantially complementary sequences of the dsRNA are contained on separate oligonucleotides. In another embodiment, the substantially complementary sequences of the dsRNA are contained on a single oligonucleotide.

It will be understood that, although the sequences in Tables 3-10 are described as modified, unmodified, unconjugated. and/or conjugated sequences, the RNA of the iRNA of the invention e.g., a dsRNA of the invention, may comprise any one of the sequences set forth in Tables 3-10 that is un-modified, un-conjugated, and/or modified and/or conjugated differently than described therein.

The skilled person is well aware that dsRNAs having a duplex structure of between about 20 and 23 base pairs, e.g., 21, base pairs have been hailed as particularly effective in inducing RNA interference (Elbashir et al., (2001) *EMBO J*, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided herein, dsRNAs described herein can include at least one strand of a length of minimally 21 nucleotides. It can be reasonably expected that shorter duplexes minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences provided herein, and differing in their ability to inhibit the expression of a GRB10 or GRB14 gene by not more than about 5, 10, 15, 20, 25, or 30% inhibition from a dsRNA comprising the full sequence, are contemplated to be within the scope of the present invention.

In addition, the RNAs described in Tables 3-10 identify a site(s) in a GRB10 or GRB14 transcript that is susceptible to RISC-mediated cleavage. As such, the present invention further features iRNAs that target within these sites. As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided herein coupled to additional nucleotide sequences taken from the region contiguous to the selected sequence in the gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a “window” or “mask” of a given size (as a non-limiting example, 21 nucleotides) is literally or figuratively (including, e.g., in silico) placed on the target RNA sequence to identify sequences in the size range that can serve as target sequences. By moving the sequence “window” progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified herein represent effective target sequences, it is contemplated that further optimization of inhibition efficiency can be achieved by progressively “walking the window” one nucleotide upstream or downstream of the given sequences to identify sequences with equal or better inhibition characteristics.

Further, it is contemplated that for any sequence identified herein, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art and/or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA agent as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of a GRB10 or GRB14 gene, generally does not contain any mismatch within the central 13 nucleotides. The methods described herein or methods known in the art can be used to determine whether an iRNA containing a mismatch to a target sequence is effective in inhibiting the expression of a GRB10 or GRB14 gene. Consideration of the efficacy of iRNAs with mismatches in inhibiting expression of a GRB10 or GRB14 gene is important, especially if the particular region of complementarity in a GRB10 or GRB14 gene is known to have polymorphic sequence variation within the population.

III. Modified iRNAs of the Invention

In one embodiment, the RNA of the iRNA of the invention e.g., a dsRNA, is un-modified, and does not comprise, e.g., chemical modifications and/or conjugations known in the art and described herein. In another embodiment, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA of the invention are modified. iRNAs of the invention in which “substantially all of the nucleotides are modified” are largely but not wholly modified and can include not more than 5, 4, 3, 2, or 1 unmodified nucleotides.

In some aspects of the invention, substantially all of the nucleotides of an iRNA of the invention are modified and the iRNA agents comprise no more than 10 nucleotides comprising 2'-fluoro modifications (e.g., no more than 9 2'-fluoro modifications, no more than 8 2'-fluoro modifications, no more than 7 2'-fluoro modifications, no more than 6 2'-fluoro modifications, no more than 5 2'-fluoro modifications, no more than 4 2'-fluoro modifications, no more than 5 2'-fluoro modifications, no more than 4 2'-fluoro modifications, no more than 3 2'-fluoro modifications, or no more than 2 2'-fluoro modifications). For example, in some embodiments, the sense strand comprises no more than 4 nucleotides comprising 2'-fluoro modifications (e.g., no more than 3 2'-fluoro modifications, or no more than 2 2'-fluoro modifications). In other embodiments, the antisense strand comprises no more than 6 nucleotides comprising 2'-fluoro modifications (e.g., no more than 5 2'-fluoro modifications, no more than 4 2'-fluoro modifications, no more than 4 2'-fluoro modifications, or no more than 2 2'-fluoro modifications).

In other aspects of the invention, all of the nucleotides of an iRNA of the invention are modified and the iRNA agents comprise no more than 10 nucleotides comprising 2'-fluoro modifications (e.g., no more than 9 2'-fluoro modifications, no more than 8 2'-fluoro modifications, no more than 7 2'-fluoro modifications, no more than 6 2'-fluoro modifications, no more than 5 2'-fluoro modifications, no more than 4 2'-fluoro modifications, no more than 5 2'-fluoro modifications, no more than 4 2'-fluoro modifications, no more than 3 2'-fluoro modifications, or no more than 2 2'-fluoro modifications).

In one embodiment, the double stranded RNAi agent of the invention further comprises a 5'-phosphate or a 5'-phosphate mimic at the 5' nucleotide of the antisense strand. In another embodiment, the double stranded RNAi agent further comprises a 5'-phosphate mimic at the 5' nucleotide of the antisense strand. In a specific embodiment, the 5'-phosphate mimic is a 5'-vinyl phosphate (5'-VP).

The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science,* 1991, 254, 1497-1500.

Some embodiments featured in the invention include RNAs with phosphorothioate backbones and oligonucleosides with heteroatom backbones, and in particular $—CH_2—NH—CH_2—$, $—CH_2—N(CH_3)—O—CH_2—$ [known as a methylene (methylimino) or MMI backbone], $—CH_2—O—N(CH_3)—CH_2—$, $—CH_2—N(CH_3)—N(CH_3)—CH_2—$ and $—N(CH_3)—CH_2—CH_2—$ [wherein the native phosphodiester backbone is represented as $—O—P—O—CH_2—$] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O—, S—, or N-alkyl; O—, S—, or N-alkenyl; O—, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2){\cdot}_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_2)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA of the invention can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., (1991) *Angewandte Chemie, International Edition,* 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

An iRNA of the invention can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

An iRNA of the invention can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH2)—O-2' (LNA); 4'-(CH2)—S-2'; 4'—(CH2)2-O-2' (ENA); 4'-CH(CH3)—O-2' (also referred to as "constrained ethyl" or "cEt") and 4'-CH(CH2OCH3)—O-2' (and analogs thereof; see, e.g., U.S. Pat. No. 7,399,845); 4'-C(CH3)(CH3)—O-2' (and analogs thereof; see e.g., U.S. Pat. No. 8,278,283); 4'-CH2-N(OCH3)-2' (and analogs thereof, see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.,* 2009, 74, 118-134); and 4'-CH2-C(═CH2)-2' (and analogs thereof, see, e.g., U.S. Pat. No. 8,278,426). The entire contents of each of the foregoing are hereby incorporated herein by reference.

Additional representative U.S. Patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

An iRNA of the invention can also be modified to include one or more constrained ethyl nucleotides. As used herein, a "constrained ethyl nucleotide" or "cEt" is a locked nucleic acid comprising a bicyclic sugar moiety comprising a 4'-CH(CH3)-0-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'—C4' have been removed (i.e. the covalent carbon-oxygen-carbon bond between the C1' and C4' carbons). In another example, the C2'—C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.,* 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-0-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of an iRNA of the invention include a 5' phosphate or 5' phosphate mimic, e.g., a 5'-terminal phosphate or phosphate mimic on the antisense strand of an RNAi agent. Suitable phosphate mimics are disclosed in, for example US Patent Publication No. 2012/0157511, the entire contents of which are incorporated herein by reference.

In certain specific embodiments, an RNAi agent of the present invention is an agent that inhibits the expression of a GRB10 gene which is selected from the group of agents listed in any one of Tables 3-6. Any of these agents may further comprise a ligand.

In certain specific embodiments, an RNAi agent of the present invention is an agent that inhibits the expression of a GRB14 gene which is selected from the group of agents listed in any one of Tables 7-10. Any of these agents may further comprise a ligand.

A. Modified iRNAs Comprising Motifs of the Invention

In certain aspects of the invention, the double stranded RNAi agents of the invention include agents with chemical modifications as disclosed, for example, in WO 2013/075035, filed on Nov. 16, 2012, the entire contents of which are incorporated herein by reference. The RNAi agent may be optionally conjugated with a GalNAc ligand, for instance on the sense strand. The RNAi agent may be optionally conjugated with a lipophilic ligand, e.g., a C16 ligand, for instance on the sense strand.

Accordingly, the invention provides double stranded RNAi agents capable of inhibiting the expression of a target gene (i.e., a GRB10 or GRB14 gene) in vivo. The RNAi agent comprises a sense strand and an antisense strand. Each strand of the RNAi agent may range from 12-30 nucleotides in length. For example, each strand may be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length. In one embodiment, the sense strand is 21 nucleotides in length. In one embodiment, the antisense strand is 23 nucleotides in length.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length.

In one embodiment, the RNAi agent may contain one or more overhang regions and/or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-Omethyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3-terminal end of the sense strand or, alternatively, at the 3-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang.

Preferably, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (preferably $GalNAc_3$, optionally a lipophilic ligand, such as a C16 ligand).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand.

For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term “wing modification” herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other, then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, every nucleotide in the sense strand and antisense strand of the RNAi agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with “dephospho” linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases, the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In one embodiment, the $N_a$ and/or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In one embodiment, the RNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 5'-3' of the strand within the duplex region. As another example, the alternating motif in the sense strand may start with "AABBAABB" from 5'-3' of the strand and the alternating motif in the antisense strand may start with "BBAABBAA" from 5'-3' of the strand within the duplex region, so that there is a complete or partial shift of the modification patterns between the sense strand and the antisense strand.

In one embodiment, the RNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand surprisingly enhances the gene silencing activity to the target gene.

In one embodiment, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotides, and "$N_a$" and "$N_b$" represent a modification to the nucleotide next to the motif "YYY" that is different than the modification of Y, and where $N_a$ and $N_b$ can be the same or different modifications. Alternatively, $N_a$ and/or $N_b$ may be present or absent when there is a wing modification present.

The RNAi agent may further comprise at least one phosphorothioate or methylphosphonate internucleotide linkage. The phosphorothioate or methylphosphonate internucleotide linkage modification may occur on any nucleotide of the sense strand or antisense strand or both strands in any position of the strand. For instance, the internucleotide linkage modification may occur on every nucleotide on the sense strand and/or antisense strand; each internucleotide linkage modification may occur in an alternating pattern on the sense strand and/or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8phosphorothioate internucleotide linkages. In one embodiment, the antisense strand comprises two phosphorothioate internucleotide linkages at the 5'-terminus and two phosphorothioate internucleotide linkages at the 3'-terminus, and the sense strand comprises at least two phosphorothioate internucleotide linkages at either the 5'-terminus or the 3'-terminus.

In one embodiment, the RNAi comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, and/or the 5'end of the antisense strand.

In one embodiment, the 2 nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the RNAi agent may additionally have two phosphorothioate internucleotide linkages between the terminal three nucleotides at both the 5'-end of the sense strand and at the 5'-end of the antisense strand.

In one embodiment, the RNAi agent comprises mismatch(es) with the target, within the duplex, or combinations thereof. The mistmatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense and/or antisense strand.

In one embodiment, the sense strand sequence may be represented by formula (I):

$$5'n_p\text{-}N_a\text{—}(XXX)_i\text{—}N_b\text{—}YYY\text{—}N_b\text{—}(ZZZ)_j\text{—}N_a\text{-}n_q3' \quad (I)$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein Nb and Y do not have the same modification; and

XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11,12 or 11, 12, 13) of—the sense strand, the count starting from the 1st nucleotide, from the 5'-end; or optionally, the count starting at the 1st paired nucleotide within the duplex region, from the 5'-end.

In one embodiment, i is 1 and j is 0, or i is 0 and j is 1, or both i and j are 1. The sense strand can therefore be represented by the following formulas:

$$5'n_p\text{-}N_a\text{—}YYY\text{—}N_b\text{—}ZZZ\text{—}N_a\text{-}n_q3' \quad (Ib);$$

$$5'n_p\text{-}N_a\text{—}XXX\text{—}N_b\text{—}YYY\text{—}N_a\text{-}n_q3' \quad (Ic); \text{ or}$$

$$5'n_p\text{-}N_a\text{—}XXX\text{—}N_b\text{—}YYY\text{—}N_b\text{—}ZZZ\text{—}N_a\text{-}n_q3' \quad (Id).$$

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$$5'n_p\text{-}N_a\text{—}YYY\text{—}N_a\text{-}n_q3' \quad (Ia).$$

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

$$5'n_{q'}\text{—}N_a'\text{—}(Z'Z'Z')_k\text{—}N_b'\text{—}Y'Y'Y'\text{—}N_b'\text{—}(X'X'X')_l\text{—}N'_a\text{-}n_p'3' \quad (II)$$

wherein:

k and l are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the $1^{st}$ nucleotide, from the 5'-end; or optionally, the count starting at the $1^{st}$ paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and 1 is 0, or k is 0 and 1 is 1, or both k and 1 are 1.

The antisense strand can therefore be represented by the following formulas:

$$5'n_{q'}\text{—}N_a'\text{—}Z'Z'Z'\text{—}N_b'\text{—}Y'Y'Y'\text{—}N_a'\text{-}n_p 3' \quad \text{(IIb);}$$

$$5'n_{q'}\text{—}N_a'\text{—}Y'Y'Y'\text{—}N_b'\text{—}X'X'X'\text{-}n_p 3' \quad \text{(IIc); or}$$

$$5'n_{q'}\text{—}N_a'\text{—}Z'Z'Z'\text{—}N_b'\text{—}Y'Y'Y'\text{—}N_b'\text{—}X'X'X'\text{—}N_a'\text{-}n_p\text{=}3' \quad \text{(IId).}$$

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and 1 is 0 and the antisense strand may be represented by the formula:

$$5'n_p'\text{—}N_a'\text{—}Y'Y'Y'\text{—}N_a\text{-}n_q 3' \quad \text{(Ia).}$$

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the $1^{st}$ nucleotide from the 5'-end, or optionally, the count starting at the $1^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1st nucleotide from the 5' end, or optionally, the count starting at the 1st paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the RNAi agents for use in the methods of the invention may comprise a sense strand and an antisense strand, each strand having 14 to 30 nucleotides, the RNAi duplex represented by formula (III):

$$\text{sense: } 5'np\text{-}Na\text{—}(XXX)i\text{-}Nb\text{—}YYY\text{-}Nb\text{—}(ZZZ)j\text{-}Na\text{-}nq3'$$

$$\text{antisense: } 3'np'\text{-}Na'\text{—}(X'X'X')k\text{-}Nb'\text{—}Y'Y'Y'\text{-}Nb'\text{—}(Z'Z'Z')l\text{-}Na'\text{-}nq'5' \quad \text{(III)}$$

wherein:

i, j, k, and l are each independently 0 or 1;

p, p', q, and q' are each independently 0-6;

each Na and Na' independently represents an oligonucleotide sequence comprising 0-25 modified nucleotides, each sequence comprising at least two differently modified nucleotides;

each Nb and Nb' independently represents an oligonucleotide sequence comprising 0-10 modified nucleotides;

wherein each np', np, nq', and nq, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and 1 is 0; or k is 1 and 1 is 0; k is 0 and 1 is 1; or both k and 1 are 0; or both k and 1 are 1.

Exemplary combinations of the sense strand and antisense strand forming a RNAi duplex include the formulas below:

$$5'np\text{-}Na\text{—}YYY\text{-}Na\text{-}nq3'$$

$$3'np'\text{-}Na'\text{—}Y'Y'Y'\text{-}Na'nq'5' \quad \text{(IIIa)}$$

5′*np*-N*a*—YYY-N*b*—ZZZ-N*a*-*nq*3′

3′*np*′-N*a*′—Y′Y′Y′-N*b*′—Z′Z′Z′-N*a*′*nq*′5′ (IIIb)

5′*np*-N*a*—XXX-N*b*—YYY-N*a*-*nq*3′

3′*np*′-N*a*′—X′X′X′-N*b*′—Y′Y′Y′-N*a*′-*nq*′5′ (IIIc)

5′*np*-N*a*—XXX-N*b*—YYY-N*b*—ZZZ-N*a*-*nq*3′

3′*np*′-N*a*′—X′X′X′-N*b*′—Y′Y′Y′-N*b*′—Z′Z′Z′-N*a*-*nq*′5′ (IIId)

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each Nb independently represents an oligonucleotide sequence comprising 1-10, 1-7, 1-5 or 1-4 modified nucleotides. Each Na independently represents an oligonucleotide sequence comprising 2-20, 2-15, or 2-10 modified nucleotides.

When the RNAi agent is represented as formula (IIc), each Nb, Nb' independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each Nb, Nb' independently represents an oligonucleotide sequence comprising 0-10, 0-7, 0-10, 0-7, 0-5, 0-4, 0-2 or O modified nucleotides. Each Na, Na' independently represents an oligonucleotide sequence comprising 2-20, 2-15, or 2-10 modified nucleotides. Each of Na, Na', Nb and Nb' independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, when the RNAi agent is represented by formula (IIId), the Na modifications are 2'-O-methyl or 2'-fluoro modifications. In another embodiment, when the RNAi agent is represented by formula (IIId), the Na modifications are 2'-O-methyl or 2'-fluoro modifications and np'>0 and at least one np' is linked to a neighboring nucleotide a via phosphorothioate linkage. In yet another embodiment, when the RNAi agent is represented by formula (IIId), the Na modifications are 2'-O-methyl or 2'-fluoro modifications, np'>0 and at least one np' is linked to a neighboring nucleotide via phosphorothioate linkage, and the sense strand is conjugated to one or more GalNAc derivatives attached through a bivalent or trivalent branched linker (described below). In another embodiment, when the RNAi agent is represented by formula (IIId), the Na modifications are 2'-O-methyl or 2'-fluoro modifications, np'>0 and at least one np' is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (IIId), the Na modifications are 2'-O-methyl or 2'-fluoro modifications. In another embodiment, when the RNAi agent is represented by formula (IIId), the Na modifications are 2'-O-methyl or 2'-fluoro modifications and np'>0 and at least one np' is linked to a neighboring nucleotide a via phosphorothioate linkage. In yet another embodiment, when the RNAi agent is represented by formula (IIId), the Na modifications are 2'-O-methyl or 2'-fluoro modifications, np'>0 and at least one np' is linked to a neighboring nucleotide via phosphorothioate linkage, and the sense strand is conjugated to one or more lipophilic, e.g., C16 (or related) moieties, attached through a bivalent or trivalent branched linker (described elsewhere herein). In another embodiment, when the RNAi agent is represented by formula (IIId), the Na modifications are 2'-O-methyl or 2'-fluoro modifications, np'>0 and at least one np' is linked to a neighboring nucleotide via phosphorothioate linkage, the sense strand comprises at least one phosphorothioate linkage, and the sense strand is conjugated to one or more lipophilic, e.g., C16 (or related) moieties, attached through a bivalent or trivalent branched linker.

In one embodiment, when the RNAi agent is represented by formula (IIIa), the Na modifications are 2'-O-methyl or 2'-fluoro modifications, np'>0 and at least one np' is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (IIIa), the Na modifications are 2'-O-methyl or 2'-fluoro modifications, np'>0 and at least one np' is linked to a neighboring nucleotide via phosphorothioate linkage, the sense strand comprises at least one phosphorothioate linkage, and the sense strand is conjugated to one or more more lipophilic, e.g., C16 (or related) moieties, attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra-low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric RNAi agents that can be used in the methods of the invention. Such publications include WO2007/091269, U.S. Pat. No. 7,858, 769, WO2010/141511, WO2007/117686, WO2009/014887 and WO2011/031520 the entire contents of each of which are hereby incorporated herein by reference.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In another embodiment of the invention, an iRNA agent comprises a sense strand and an antisense strand, each strand having 14 to 40 nucleotides. The RNAi agent may be represented by formula (L):

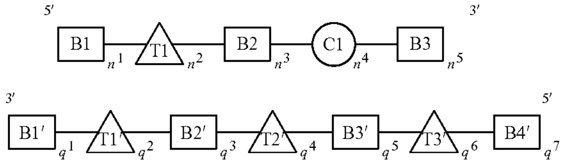

(L),

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In certain embodiments, B1, B2, B3, B1', B2', B3', and B4' each contain 2'-OMe modifications. In certain embodiments, B1, B2, B3, B1', B2', B3', and B4' each contain 2'-OMe or 2'-F modifications. In certain embodiments, at least one of B1, B2, B3, B1', B2', B3', and B4' contain 2'-O—N-methylacetamido (2'-O-NMA) modification.

C1 is a thermally destabilizing nucleotide placed at a site opposite to the seed region of the antisense strand (i.e., at positions 2-8 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In certain embodiments, C1 has thermally destabilizing modification selected from the group consisting of: i) mismatch with the opposing nucleotide in the antisense strand; ii) abasic modification selected from the group consisting of:

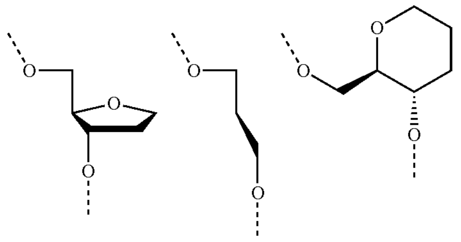

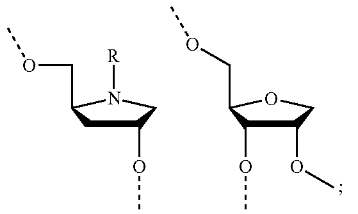

and iii) sugar modification selected from the group consisting of:

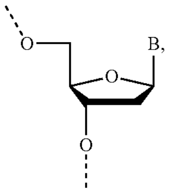

2'-deoxy

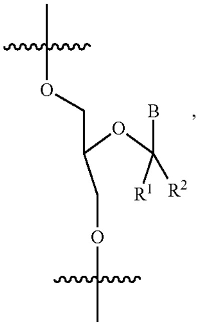

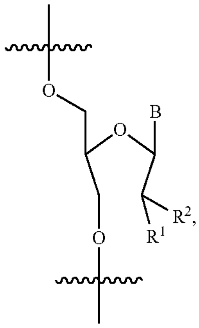

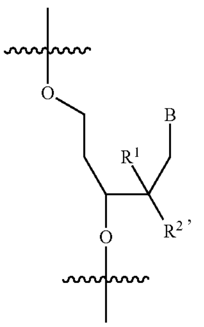

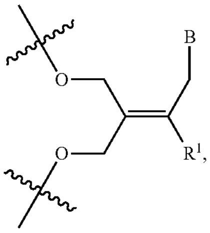

and

-continued

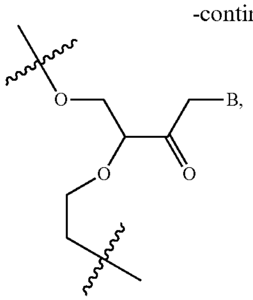

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar. In certain embodiments, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

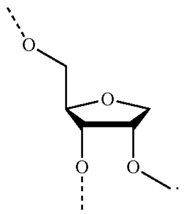

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In certain embodiments, T1 is DNA. In certain embodiments, T1' is DNA, RNA or LNA. In certain embodiments, T2' is DNA or RNA. In certain embodiments, T3' is DNA or RNA.

$n^1$, $n^3$, and q are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length.

Alternatively, $n^4$ is 0-3 nucleotide(s) in length.

In certain embodiments, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, $n^4$, $q^2$, and $q^6$ are each 1.

In certain embodiments, $n^2$, $n^4$, $q^2$, $q^4$, and $q^6$ are each 1.

In certain embodiments, C1 is at position 14-17 of the 5'-end of the sense strand, when the sense strand is 19-22 nucleotides in length, and $n^4$ is 1. In certain embodiments, C1 is at position 15 of the 5'-end of the sense strand In certain embodiments, T3' starts at position 2 from the 5' end of the antisense strand. In one example, T3' is at position 2 from the 5' end of the antisense strand and $q^6$ is equal to 1.

In certain embodiments, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In certain embodiments, T1' and T3' are separated by 11 nucleotides in length (i.e. not counting the T1' and T3' nucleotides).

In certain embodiments, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In certain embodiments, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In certain embodiments, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In certain embodiments, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In certain embodiments, T2' starts at position 8 from the 5' end of the antisense strand. In one example, T2' starts at position 8 from the 5' end of the antisense strand, and $q^4$ is 2.

In certain embodiments, T2' starts at position 9 from the 5' end of the antisense strand. In one example, T2' is at position 9 from the 5' end of the antisense strand, and $q^4$ is 1.

In certain embodiments, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In certain embodiments, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-$PS_2$), 5'-end vinylphosphonate (5'-VP), 5'-end methylphosphonate (MePhos), or 5'-deoxy-5'-C-malonyl (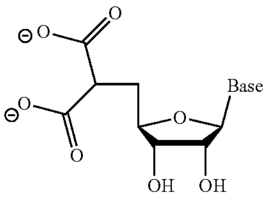).

When the 5'-end phosphorus-containing group is 5'-end vinylphosphonate (5'-VP), the 5'-VP can be either 5'-E-VP isomer (i.e., trans-vinylphosphonate,

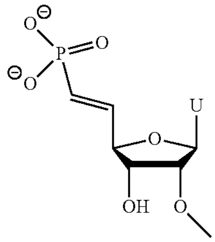),

5'-Z—VP isomer (i.e., cis-vinylphosphonate,

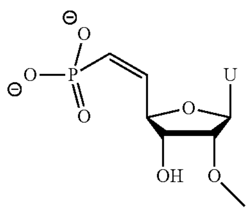), or mixtures thereof.

In certain embodiments, the RNAi agent comprises a phosphorus-containing group at the 5'-end of the sense strand. In certain embodiments, the RNAi agent comprises a phosphorus-containing group at the 5'-end of the antisense strand.

In certain embodiments, the RNAi agent comprises a 5'-P. In certain embodiments, the RNAi agent comprises a 5'-P in the antisense strand.

In certain embodiments, the RNAi agent comprises a 5'-PS. In certain embodiments, the RNAi agent comprises a 5'-PS in the antisense strand.

In certain embodiments, the RNAi agent comprises a 5'-VP. In certain embodiments, the RNAi agent comprises a 5'-VP in the antisense strand. In certain embodiments, the RNAi agent comprises a 5'-E-VP in the antisense strand. In certain embodiments, the RNAi agent comprises a 5'-Z—VP in the antisense strand.

In certain embodiments, the RNAi agent comprises a 5'-$PS_2$. In certain embodiments, the RNAi agent comprises a 5'-$PS_2$ in the antisense strand.

In certain embodiments, the RNAi agent comprises a 5'-$PS_2$. In certain embodiments, the RNAi agent comprises a 5'-deoxy-5'-C-malonyl in the antisense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z—VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z—VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z—VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z—VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z—VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNA RNA agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z—VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z—VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z—VP, or combination thereof.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In certain embodiments, the 5'-P is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In certain embodiments, the 5'-PS is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z—VP, or combination thereof), and a targeting ligand.

In certain embodiments, the 5'-VP is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In certain embodiments, the 5'-$PS_2$ is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In certain embodiments, the 5'-deoxy-5'-C-malonyl is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In certain embodiments, the 5'-P is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS and a targeting ligand. In certain embodiments, the 5'-PS is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z—VP, or combination thereof) and a targeting ligand. In certain embodiments, the 5'-VP is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-$PS_2$ and a targeting ligand. In certain embodiments, the 5'-$PS_2$ is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In certain embodiments, the 5'-deoxy-5'-C-malonyl is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In certain embodiments, the 5'-P is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In certain embodiments, the 5'-PS is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z—VP, or combination thereof) and a targeting ligand. In certain embodiments, the 5'-VP is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In certain embodiments, the 5'-$PS_2$ is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In certain embodiments, the 5'-deoxy-5'-C-malonyl is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In certain embodiments, the 5'-P is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In certain embodiments, the 5'-PS is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z—VP, or combination thereof) and a targeting ligand. In certain embodiments, the 5'-VP is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-$PS_2$ and a targeting ligand. In certain embodiments, the 5'-$PS_2$ is at the 5'-end of the antisense strand, and the targeting ligand is at the 3'-end of the sense strand.

In certain embodiments, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In certain embodiments, the 5'-deoxy-5'-C-malonyl is at the 5'-end of the antisense strand, and the targeting ligand is at the 3'-end of the sense strand.

In a particular embodiment, an RNAi agent of the present invention comprises:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker; and
  (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end);

and (b) an antisense strand having:
  (i) a length of 23 nucleotides;
  (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
  (iii) phosphorothioate internucleotide linkages between nucleotide positions 21 and 22, and between nucleotide positions 22 and 23 (counting from the 5' end);

wherein the dsRNA agents have a two-nucleotide overhang at the 3'-end of the antisense strand, and a blunt end at the 5'-end of the antisense strand.

In another particular embodiment, an RNAi agent of the present invention comprises:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
  (iv) phosphorothioate internucleotide linkages between nucleotide positions 1 and 2, and between nucleotide positions 2 and 3 (counting from the 5' end); and (b) an antisense strand having:
  (i) a length of 23 nucleotides;
  (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, an RNAi agent of the present invention comprises:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, 10, and 12 to 21, 2'—F modifications at positions 7, and 9, and a deoxy-nucleotide (e.g. dT) at position 11 (counting from the 5' end); and
  (iv) phosphorothioate internucleotide linkages between nucleotide positions 1 and 2, and between nucleotide positions 2 and 3 (counting from the 5' end);

and (b) an antisense strand having:
  (i) a length of 23 nucleotides;
  (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, an RNAi agent of the present invention comprises:

(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 6, 8, 10, 12, 14, and 16 to 21, and 2'-F modifications at positions 7, 9, 11, 13, and 15; and
 (iv) phosphorothioate internucleotide linkages between nucleotide positions 1 and 2, and between nucleotide positions 2 and 3 (counting from the 5' end);

and (b) an antisense strand having:
 (i) a length of 23 nucleotides;
 (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, an RNAi agent of the present invention comprises:

(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 9, and 12 to 21, and 2'-F modifications at positions 10, and 11; and
 (iv) phosphorothioate internucleotide linkages between nucleotide positions 1 and 2, and between nucleotide positions 2 and 3 (counting from the 5' end);

and (b) an antisense strand having:
 (i) a length of 23 nucleotides;
 (ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, a RNAi agent of the present invention comprises:

(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-F modifications at positions 1, 3, 5, 7, 9 to 11, and 13, and 2'-OMe modifications at positions 2, 4, 6, 8, 12, and 14 to 21; and
 (iv) phosphorothioate internucleotide linkages between nucleotide positions 1 and 2, and between nucleotide positions 2 and 3 (counting from the 5' end);

and (b) an antisense strand having:
 (i) a length of 23 nucleotides;
 (ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, an RNAi agent of the present invention comprises:

(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and (iv) phosphorothioate internucleotide linkages between nucleotide positions 1 and 2, and between nucleotide positions 2 and 3 (counting from the 5' end);

and (b) an antisense strand having:
 (i) a length of 25 nucleotides;
 (ii) 2'-OMe modifications at positions 1, 4, 6, 7, 9, 11 to 13, 15, 17, and 19 to 23, 2'—F modifications at positions 2, 3, 5, 8, 10, 14, 16, and 18, and deoxy-nucleotides (e.g. dT) at positions 24 and 25 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a four-nucleotide overhang at the 3'-end of the antisense strand, and a blunt end at the 5'-end of the antisense strand.

In another particular embodiment, a RNAi agent of the present invention comprises:

(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 6, 8, and 12 to 21, and 2'-F modifications at positions 7, and 9 to 11; and
 (iv) phosphorothioate internucleotide linkages between nucleotide positions 1 and 2, and between nucleotide positions 2 and 3 (counting from the 5' end);

and (b) an antisense strand having:

(i) a length of 23 nucleotides;

(ii) 2'-OMe modifications at positions 1, 3 to 5, 7, 8, 10 to 13, 15, and 17 to 23, and 2'-F modifications at positions 2, 6, 9, 14, and 16 (counting from the 5' end); and (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, a RNAi agent of the present invention comprises:

(a) a sense strand having:

(i) a length of 21 nucleotides;

(ii) an ASGPR ligand attached to the 3'-end, wherein said ASGPR ligand comprises three GalNAc derivatives attached through a trivalent branched linker;

(iii) 2'-OMe modifications at positions 1 to 6, 8, and 12 to 21, and 2'-F modifications at positions 7, and 9 to 11; and (iv) phosphorothioate internucleotide linkages between nucleotide positions 1 and 2, and between nucleotide positions 2 and 3 (counting from the 5' end);

and (b) an antisense strand having:

(i) a length of 23 nucleotides;

(ii) 2'-OMe modifications at positions 1, 3 to 5, 7, 10 to 13, 15, and 17 to 23, and 2'-F modifications at positions 2, 6, 8, 9, 14, and 16 (counting from the 5' end); and (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two-nucleotide overhang at the 3'-end of the antisense strand, and a blunt end at the 5'-end of the antisense strand.

In another particular embodiment, a RNAi agent of the present invention comprises:

(a) a sense strand having:

(i) a length of 19 nucleotides;

(ii) an ASGPR ligand attached to the 3'-end, wherein said ASGPR ligand comprises three GalNAc derivatives attached through a trivalent branched linker;

(iii) 2'-OMe modifications at positions 1 to 4, 6, and 10 to 19, and 2'-F modifications at positions 5, and 7 to 9; and (iv) phosphorothioate internucleotide linkages between nucleotide positions 1 and 2, and between nucleotide positions 2 and 3 (counting from the 5' end);

and (b) an antisense strand having:

(i) a length of 21 nucleotides;

(ii) 2'-OMe modifications at positions 1, 3 to 5, 7, 10 to 13, 15, and 17 to 21, and 2'-F modifications at positions 2, 6, 8, 9, 14, and 16 (counting from the 5' end); and (iii) phosphorothioate internucleotide linkages between nucleotide positions 1 and 2, between nucleotide positions 2 and 3, between nucleotide positions 19 and 20, and between nucleotide positions 20 and 21 (counting from the 5' end);

wherein the RNAi agents have a two-nucleotide overhang at the 3'-end of the antisense 5 strand, and a blunt end at the 5'-end of the antisense strand.

In certain embodiments, the iRNA for use in the methods of the invention is an agent selected from agents listed in any one of Tables 3-6. In one embodiment, the agent is AD-1302784, AD-1302785, AD-1302786, AD-1302787, AD-1302788, AD-1302789, AD-1302790, AD-1302791, AD-1302792, AD-1302793, AD-1302794, AD-1302795, AD-1302796, AD-1302797, AD-1302798, AD-1302799, AD-1302800, AD-1302801, AD-1302802, AD-1302803, AD-1302804, AD-1302805, AD-1302806, AD-1302807, AD-1302808, AD-1302809, AD-1302810, AD-1302811, AD-1302812, AD-1302813, AD-1302814, AD-1302815, AD-1302816, AD-1302817, AD-1302818, AD-1302819, AD-1302820, AD-1302821, AD-1302822, AD-1302823, AD-1302824, AD-1302825, AD-1302826, AD-1302827, AD-1302828, AD-1302829, AD-1302830, AD-1302831, AD-1302832, AD-1302833, AD-1302834, AD-1302835, AD-1302836, AD-1302837, AD-1302838, AD-1302839, AD-1302840, AD-1302841, AD-1302842, AD-1302843, AD-1302844, AD-1302845, AD-1302846, AD-1302847, AD-1302848, AD-1302849, AD-1302850, AD-1302851, AD-1302852, AD-1302853, AD-1302854, AD-1302855, AD-1302856, AD-1302857, AD-1302858, AD-1302859, AD-1302860, AD-1302861, AD-1302862, AD-1302863, AD-1302864, AD-1302865, AD-1302866, AD-1302867, AD-1302868, AD-1302869, AD-1302870, AD-1302871, AD-1302872, AD-1302873, AD-1302874, AD-1302875, AD-1302876, AD-1302877, AD-1302878, AD-1302879, AD-1302880, AD-1302881, AD-1302882, AD-1302883, AD-1302884, AD-1302885, AD-1302886, AD-1302887, AD-1302888, AD-1302889, AD-1302890, AD-1302891, AD-1302892, AD-1302893, AD-1302894, AD-1302895, AD-1302896, AD-1302897, AD-1302898, AD-1302899, AD-1302900, AD-1302901, AD-1302902, AD-1302903, AD-1302904, AD-1302905, AD-1302906, AD-1302907, AD-1302908, AD-1302909, AD-1302910, AD-1302911, AD-1302912, AD-1302913, AD-1302914, AD-1302915, AD-1302916, AD-1302917, AD-1302918, AD-1364730, AD-1365058, AD-1365135, AD-1365142, AD-1365149, AD-1365491, AD-1416437, AD-1416444, AD-1416451, AD-1416458, AD-1416465, AD-1416471, AD-1416478, AD-1416505, AD-1416512, AD-1416519, AD-1416526, AD-1416533, AD-1416540, AD-1416547, AD-1416555, AD-1416562, AD-1416569, AD-1416576, AD-1416578, AD-1416586, AD-1416611, AD-1416620, AD-1416627, AD-1416645, AD-1416652, AD-1416674, AD-1416681, AD-1416688, AD-1416695, AD-1416699, AD-1416706, AD-1416713, AD-1416716, AD-1416723, AD-1416730, AD-1416740, AD-1416764, AD-1416774, AD-1416781, AD-1416795, AD-1416802, AD-1416809, AD-1416816, AD-1416823, AD-1416830, AD-1416837, AD-1416841, AD-1416848, AD-1416855, AD-1416863, AD-1416870, AD-1416893, AD-1416900, AD-1416907, AD-1416914, AD-1416921, AD-1416928, AD-1416935, AD-1416942, AD-1416949, AD-1416957, AD-1416964, AD-1416971, AD-1416978, AD-1417009, AD-1417016, AD-1417023, AD-1417030, AD-1417037, AD-1417044, AD-1417051, AD-1417078, AD-1417085, AD-1417092, AD-1417118, AD-1417125, AD-1417132, AD-1417154, AD-1417161, AD-1417168, AD-1417175, AD-1417182, AD-1417189, AD-1417233, AD-1417240, AD-1417247, AD-1417254, AD-1417261, AD-1417268, AD-1417275, AD-1417302, AD-1417309, AD-1417316, AD-1417323, AD-1417330, AD-1417337, AD-1417344, AD-1417351, AD-1417358, AD-1417365, AD-1417372, AD-1417401, AD-1417408, AD-1417415, AD-1417422, AD-1417429, AD-1417436, AD-1417459, AD-1417466, AD-1417473, AD-1417495, AD-1417502, AD-1417509, AD-1417516, AD-1417523, AD-1417556, AD-1417563, AD-1417570, AD-1417576, AD-1417603, AD-1417610, AD-1417617, AD-1417624, AD-1417631, AD-1417638, AD-1417645, AD-1417652, AD-1417659, or AD-1417666. These agents may further comprise a ligand.

In certain embodiments, the iRNA for use in the methods of the invention is an agent selected from agents listed in any one of Tables 7-10. In one embodiment, the agent is AD-1399762, AD-1399763, AD-1399764, AD-1399765, AD-1399766, AD-1399767, AD-1399768, AD-1399769, AD-1399770, AD-1399771, AD-1399772, AD-1399773, AD-1399774, AD-1399775, AD-1399776, AD-1399777, AD-1399778, AD-1399779, AD-1399780, AD-1399781, AD-1399782, AD-1399783, AD-1399784, AD-1399785, AD-1399786, AD-1399787, AD-1399788, AD-1399789, AD-1399790, AD-1399791, AD-1399792, AD-1399793, AD-1399794, AD-1399795, AD-1399796, AD-1399797, AD-1399798, AD-1399799, AD-1399800, AD-1399801, AD-1399802, AD-1399803, AD-1399804, AD-1399805, AD-1399806, AD-1399807, AD-1399808, AD-1399809, AD-1399810, AD-1399811, AD-1399812, AD-1399813, AD-1399814, AD-1399815, AD-1399816, AD-1399817, AD-1399818, AD-1399819, AD-1399820, AD-1399821, AD-1399822, AD-1399823, AD-1399824, AD-1399825, AD-1399826, AD-1399827, AD-1399828, AD-1399829, AD-1399830, AD-1399831, AD-1399832, AD-1399833, AD-1399834, AD-1399835, AD-1399836, AD-1399837, AD-1399838, AD-1399839, AD-1399840, AD-1399841, AD-1399842, AD-1399843, AD-1399844, AD-1399845, AD-1399846, AD-1399847, AD-1399848, AD-1399849, AD-1399850, AD-1399851, AD-1399852, AD-1399853, AD-1399854, AD-1399855, AD-1399856, AD-1399857, AD-1399858, AD-1399859, AD-1399860, AD-1399861, AD-1399862, AD-1399863, AD-1399864, AD-1399865, AD-1399866, AD-1399867, AD-1399868, AD-1399869, AD-1399870, AD-1399871, AD-1399872, AD-1399873, AD-1399874, AD-1399875, AD-1399876, AD-1399877, AD-1399878, AD-1399879, AD-1399880, AD-1399881, AD-1399882, AD-1399883, AD-1399884, AD-1399885, AD-1399886, AD-1399887, AD-1399888, AD-1399889, AD-1399890, AD-1399891, AD-1399892, AD-1399893, AD-1399894, AD-1399895, AD-1399896, AD-1589130, AD-1589133, AD-1589138, AD-1589141, AD-1589260, AD-1589263, AD-1589268, AD-1589270, AD-1589289, AD-1589292, AD-1589297, AD-1589302, AD-1589305, AD-1589316, AD-1589330, AD-1589333, AD-1589336, AD-1589341, AD-1589343, AD-1589344, AD-1589346, AD-1589351, AD-1589354, AD-1589365, AD-1589368, AD-1589373, AD-1589376, AD-1589385, AD-1589388, AD-1589393, AD-1589395, AD-1589396, AD-1589398, AD-1589403, AD-1589406, AD-1589471, AD-1589474, AD-1589479, AD-1589481, AD-1589482, AD-1589484, AD-1589489, AD-1589492, AD-1589495, AD-1589500, AD-1589502, AD-1589503, AD-1589505, AD-1589510, AD-1589513, AD-1589518, AD-1589520, AD-1589521, AD-1589523, AD-1589528, AD-1589531, AD-1589625, AD-1589628, AD-1589633, AD-1589636, AD-1589665, AD-1589668, AD-1589673, AD-1589676, AD-1589685, AD-1589688, AD-1589693, AD-1589695, AD-1589696, AD-1589698, AD-1589703, AD-1589705, AD-1589706, AD-1589708, AD-1589713, AD-1589716, AD-1589842, AD-1589845, AD-1589850, AD-1589853, AD-1589902, AD-1589905, AD-1589910, AD-1589913, AD-1589923, AD-1589925, AD-1589926, AD-1589928, AD-1589933, AD-1590015, AD-1590018, AD-1590023, AD-1590026, AD-1590045, AD-1590048, AD-1590053, AD-1590056, AD-1590085, AD-1590088, AD-1590093, AD-1590096, AD-1590145, AD-1590148, AD-1590153, AD-1590155, AD-1590156, AD-1590158, AD-1590163, AD-1590166, AD-1590192, AD-1590195, AD-1590200, AD-1590203, AD-1631258, AD-1631259, AD-1631260, AD-1631261, AD-1631262, AD-1631263, AD-1631264, AD-1631265, AD-1631266, AD-1631267, AD-1631268, AD-1631269, AD-1631270, or AD-1631271. These agents may further comprise a ligand.

IV. iRNAs Conjugated to Ligands

Another modification of the RNA of an iRNA of the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., (1989) *Proc. Natl. Acid. Sci. USA,* 86: 6553-6556), cholic acid (Manoharan et al., (1994) *Biorg. Med. Chem. Let.,* 4:1053-1060), a thioether, e.g., beryl-S-tritylthiol (Manoharan et al., (1992) *Ann. N.Y. Acad. Sci.,* 660:306-309; Manoharan et al., (1993) *Biorg. Med. Chem. Let.,* 3:2765-2770), a thiocholesterol (Oberhauser et al., (1992) *Nucl. Acids Res.,* 20:533-538), an aliphatic chain, e.g., dodecandiol or undecyl residues (Saison-Behmoaras et al., (1991) *EMBO J,* 10:1111-1118; Kabanov et al., (1990) *FEBS Lett.,* 259:327-330; Svinarchuk et al., (1993) *Biochimie,* 75:49-54), a phospholipid, e.g., di-hexadecyl-rac-glycerol or triethyl-ammonium 1,2-di-O-hexadecyl-rac-glycero-3-phosphonate (Manoharan et al., (1995) *Tetrahedron Lett.,* 36:3651-3654; Shea et al., (1990) *Nucl. Acids Res.,* 18:3777-3783), a polyamine or a polyethylene glycol chain (Manoharan et al., (1995) *Nucleosides & Nucleotides,* 14:969-973), or adamantane acetic acid (Manoharan et al., (1995) *Tetrahedron Lett.,* 36:3651-3654), a palmityl moiety (Mishra et al., (1995) *Biochim. Biophys. Acta,* 1264:229-237), or an octadecylamine or hexylamino-carbonyloxycholesterol moiety (Crooke et al., (1996) *J. Pharmacol. Exp. Ther.,* 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolide) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, (e.g., a C16 ligand, cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates and Lipophilic Moieties

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

The RNAi agent may contain or be coupled to a ligand, e.g., a lipophilic moiety or moieties as elsewhere herein and further detailed, e.g., in PCT/US2019/031 170, which is incorporated herein by reference, that directs or otherwise stabilizes the RNAi agent at a site of interest, e.g., the CNS. The term "lipophile" or "lipophilic moiety" broadly refers to any compound or chemical moiety having an affinity for lipids. One way to characterize the lipophilicity of the lipophilic moiety is by the octanol-water partition coefficient, logKow, where Kow is the ratio of a chemical's concentration in the octanol-phase to its concentration in the aqueous phase of a two-phase system at equilibrium. The octanol-water partition coefficient is a laboratory-measured property of a substance. However, it may also be predicted by using coefficients attributed to the structural components of a chemical which are calculated using first-principle or empirical methods (see, for example, Tetko et al., J. Chem. Inf. Comput. Sci. 41:1407-21 (2001), which is incorporated herein by reference in its entirety). It provides a thermodynamic measure of the tendency of the substance to prefer a non-aqueous or oily milieu rather than water (i.e. its hydrophilic/lipophilic balance). In principle, a chemical substance is lipophilic in character when its logKow exceeds 0. Typically, the lipophilic moiety possesses a logKow exceeding 1, exceeding 1.5, exceeding 2, exceeding 3, exceeding 4, exceeding 5, or exceeding 10. For instance, the logKow of 6-amino hexanol, for instance, is predicted to be approximately 0.7. Using the same method, the logKow of cholesteryl N-(hexan-6-ol) carbamate is predicted to be 10.7.

The lipophilicity of a molecule can change with respect to the functional group it carries. For instance, adding a hydroxyl group or amine group to the end of a lipophilic moiety can increase or decrease the partition coefficient (e.g., logKow) value of the lipophilic moiety.

Alternatively, the hydrophobicity of the double-stranded RNAi agent, conjugated to one or more lipophilic moieties, can be measured by its protein binding characteristics. For instance, in certain embodiments, the unbound fraction in the plasma protein binding assay of the double-stranded RNAi agent could be determined to positively correlate to the relative hydrophobicity of the double-stranded RNAi agent, which could then positively correlate to the silencing activity of the double-stranded RNAi agent.

In one embodiment, the plasma protein binding assay determined is an electrophoretic mobility shift assay (EMSA) using human serum albumin protein. An exemplary protocol of this binding assay is illustrated in detail in, e.g., PCT/US2019/031170. The hydrophobicity of the double-stranded RNAi agent, measured by fraction of unbound siRNA in the binding assay, exceeds 0.15, exceeds 0.2, exceeds 0.25, exceeds 0.3, exceeds 0.35, exceeds 0.4, exceeds 0.45, or exceeds 0.5 for an enhanced in vivo delivery of siRNA.

Accordingly, conjugating the lipophilic moieties to the internal position(s) of the double-stranded RNAi agent provides optimal hydrophobicity for the enhanced in vivo delivery of siRNA.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 49). An RFGF analogue (e.g., amino acid sequence AALLPVLLAAP (SEQ ID NO: 50) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 51) and the *Drosophila* Antennapedia protein (RQIKIWFQNRRMKWKK (SEQ ID NO: 52) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimetics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, a α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the invention is selected from the group consisting of:

Formula I

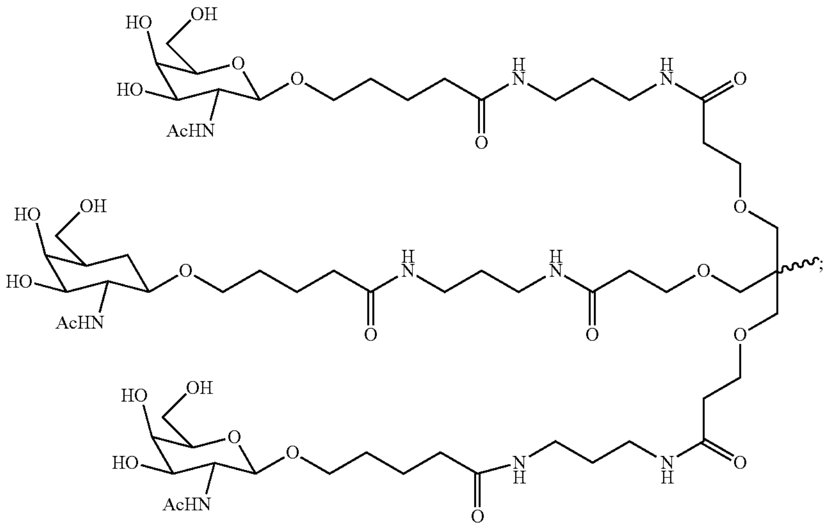

Formula II

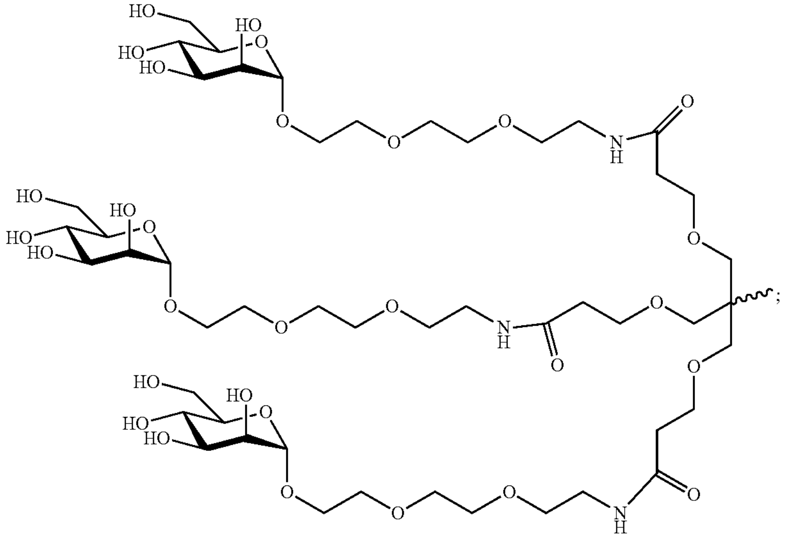

-continued
Formula III
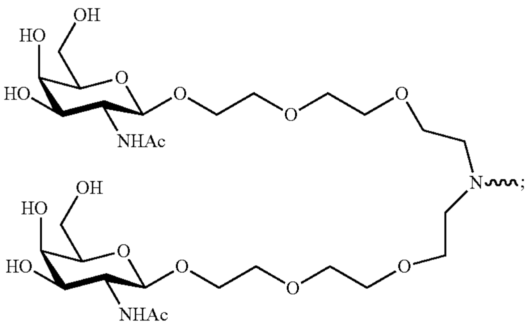
Formula IV
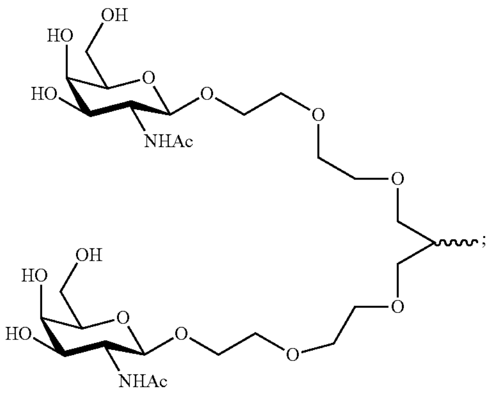
Formula V
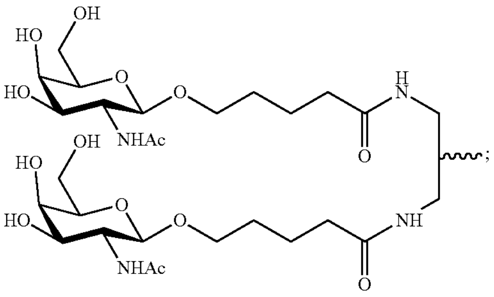
Formula VI
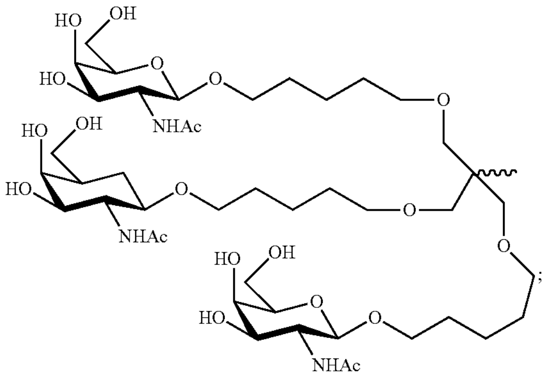
Formula VII
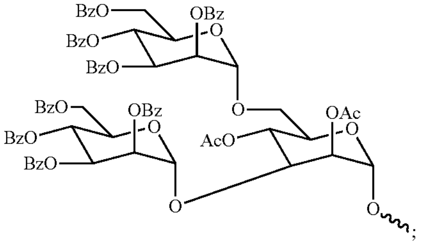
Formula VIII
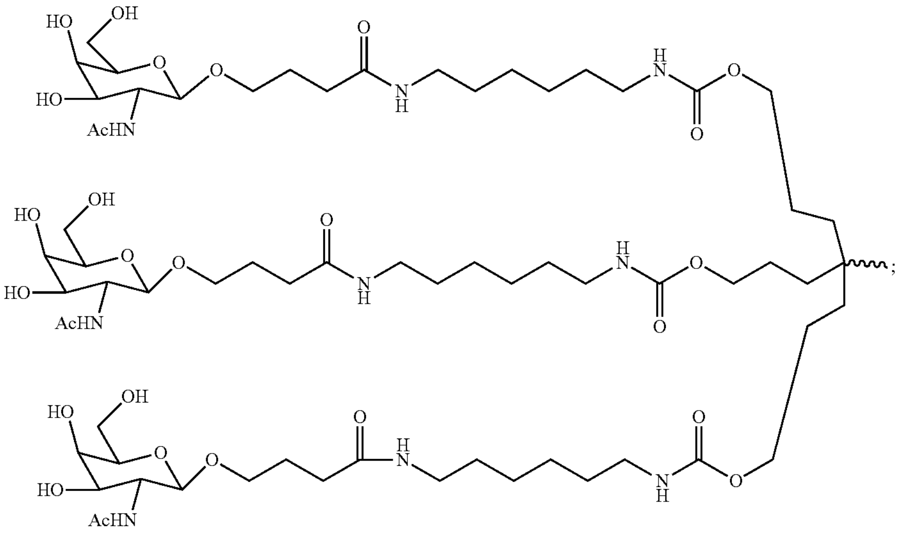

-continued
Formula IX
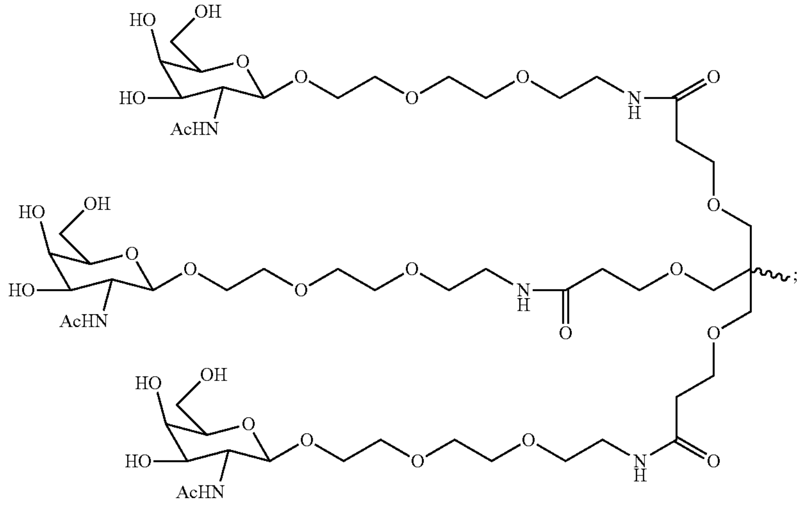
Formula X
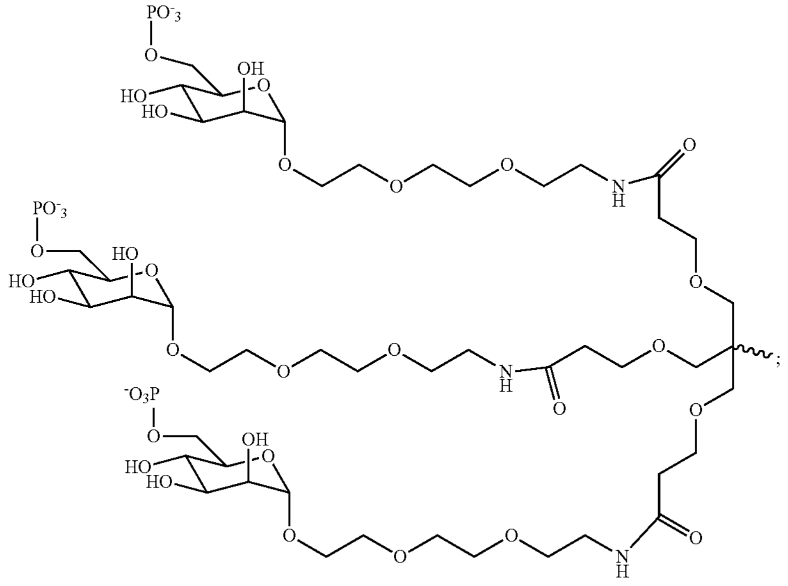

-continued
Formula XI
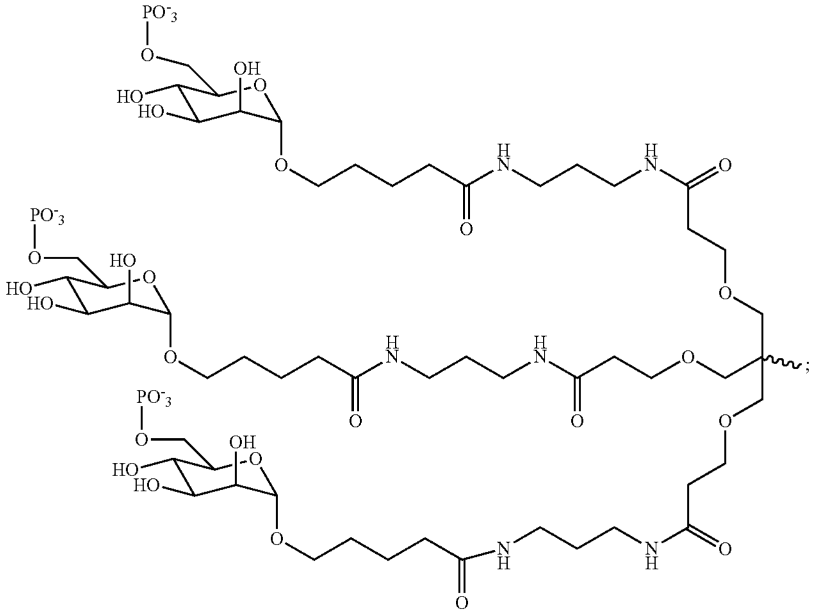
Formula XII
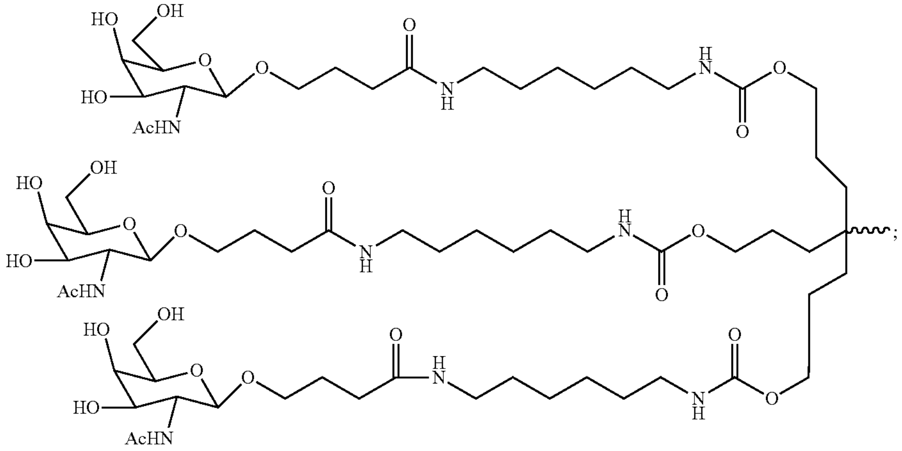
Formula XIII
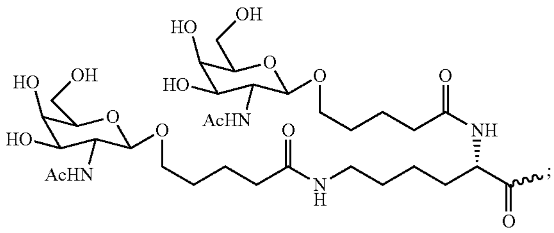
Formula XIV
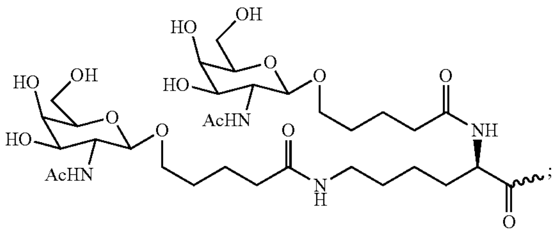
Formula XV
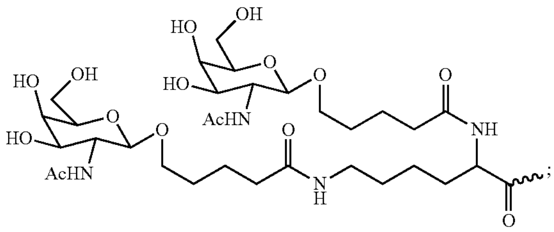
Formula XVI
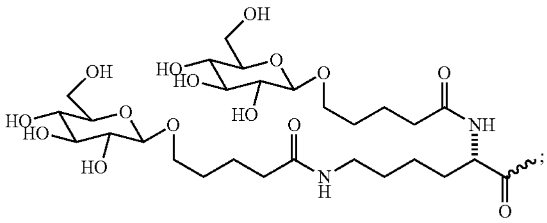

-continued
Formula XVII
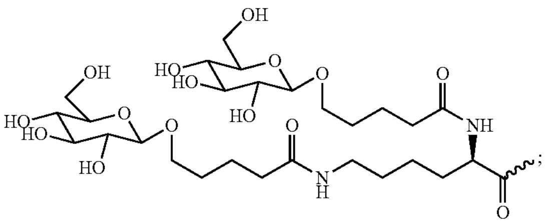
Formula XVIII
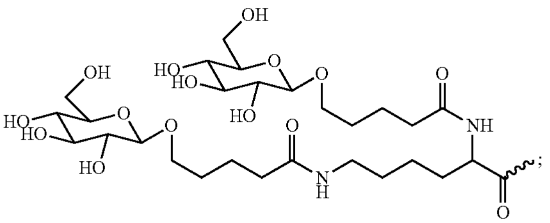
Formula XIX
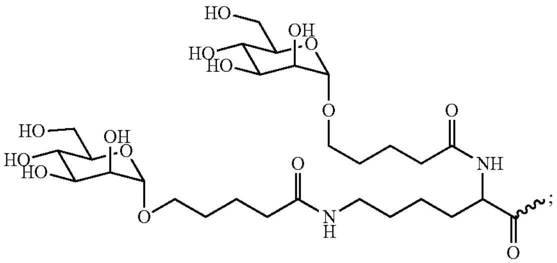
Formula XX
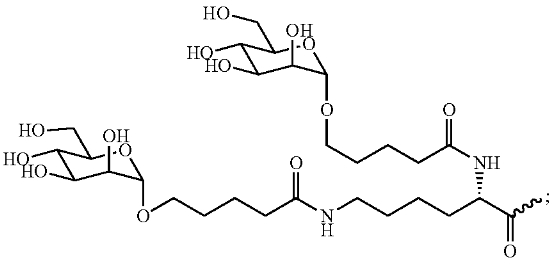
Formula XXI
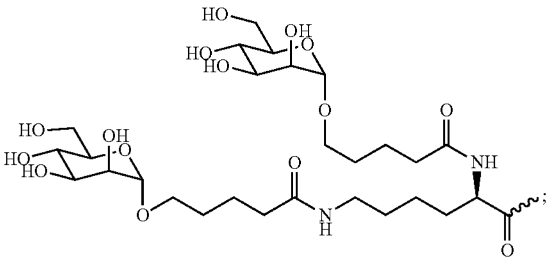
Formula XXII
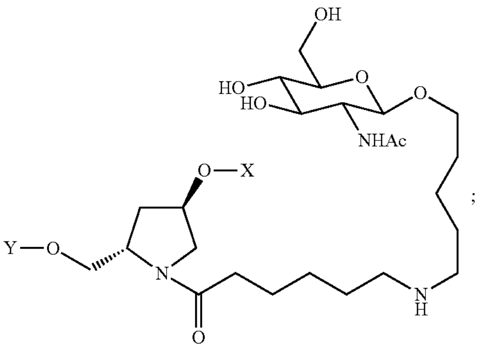
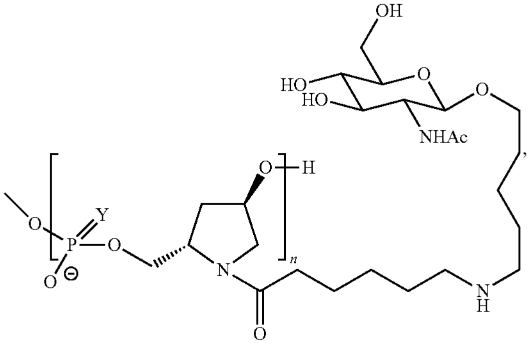
wherein Y is O or S and n is 3-6 (Formula XXIII);

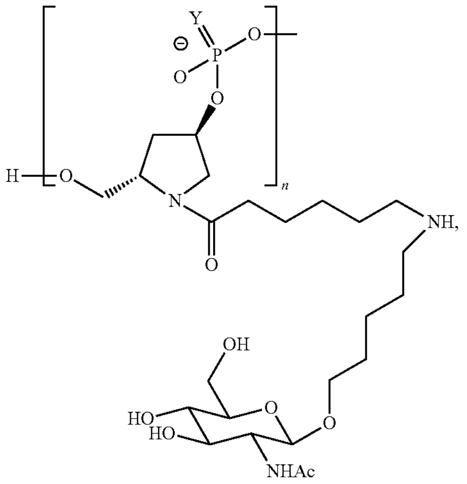
wherein Y is O or S and n is 3-6 (Formula XXIV);
Formula XXV
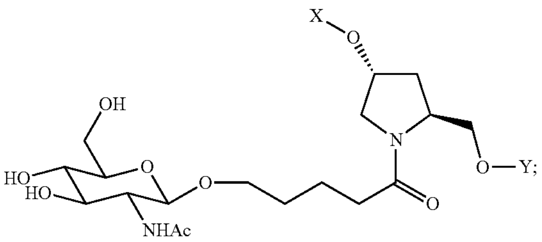
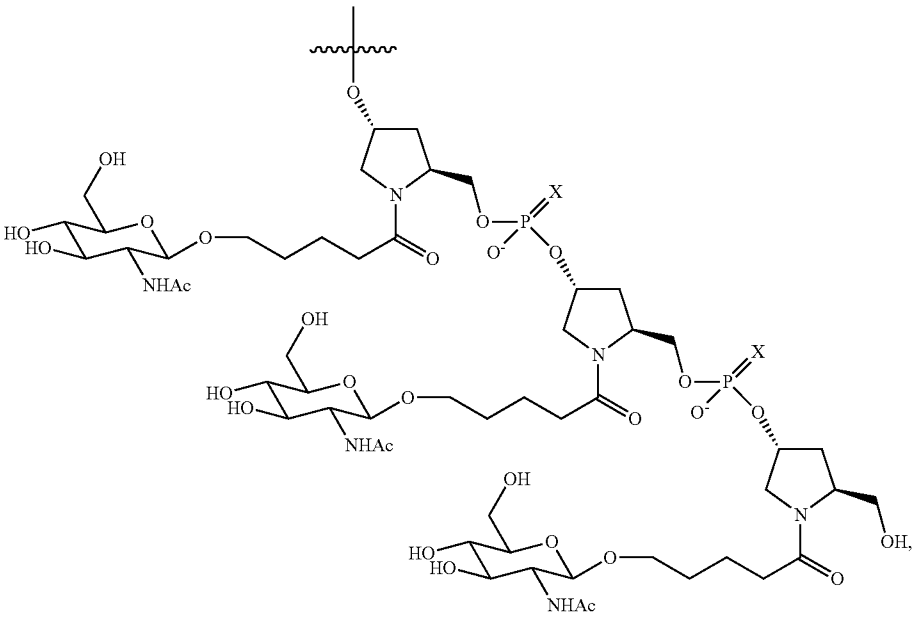
wherein X is O or S (Formula XXVI);

Formula XXVII
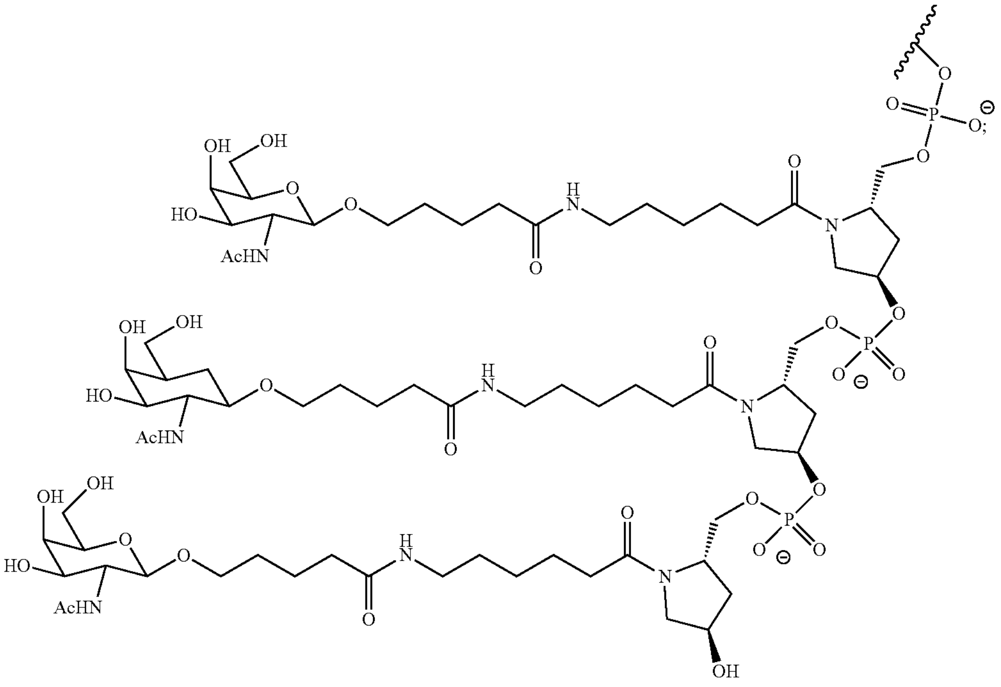
Formula XXVIII
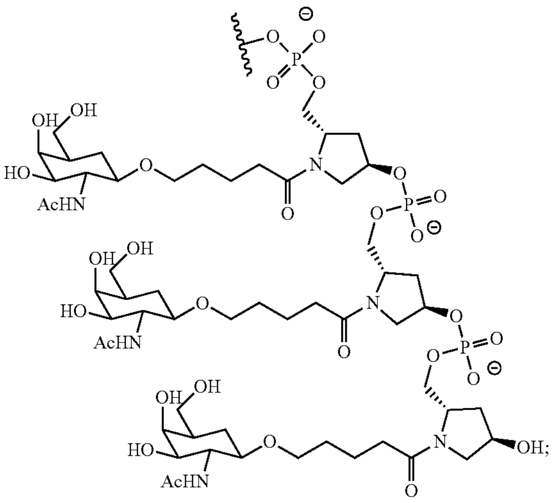

-continued
Formula XXIX
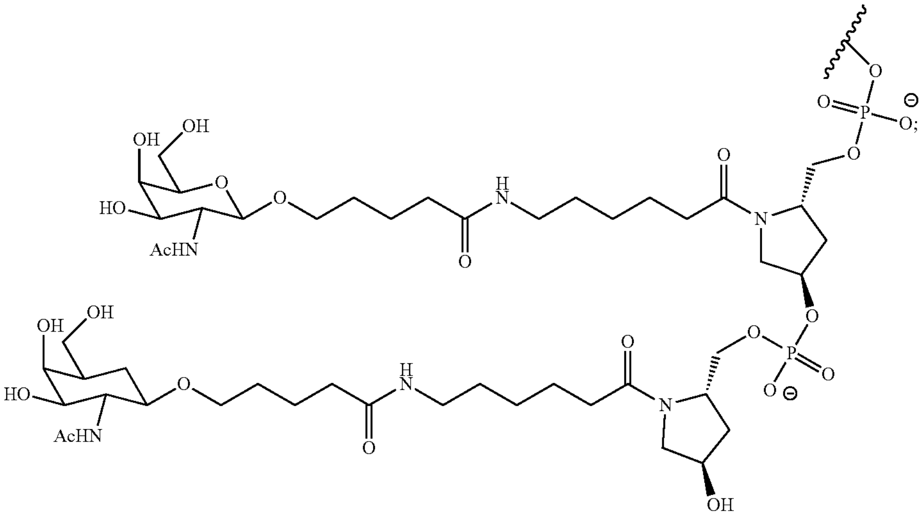
Formula XXX
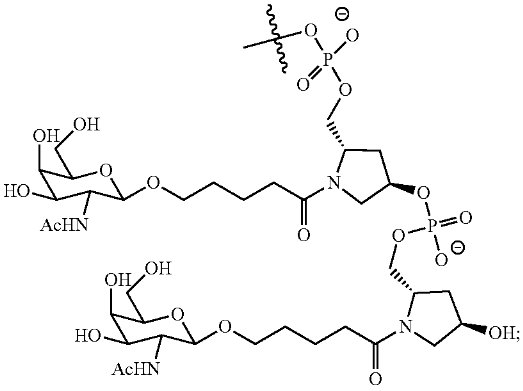
Formula XXXI
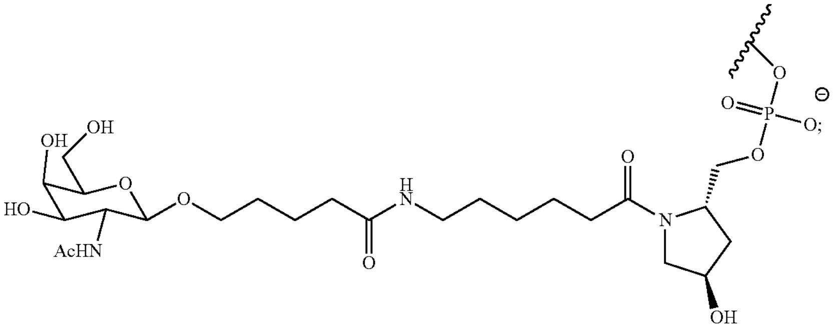
Formula XXXII
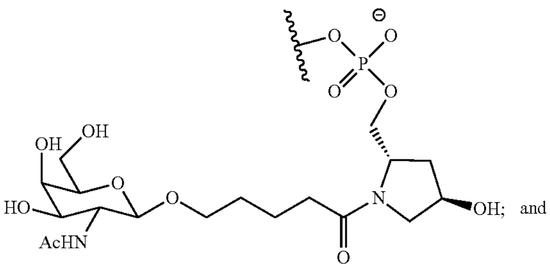
and -continued Formula XXXIII

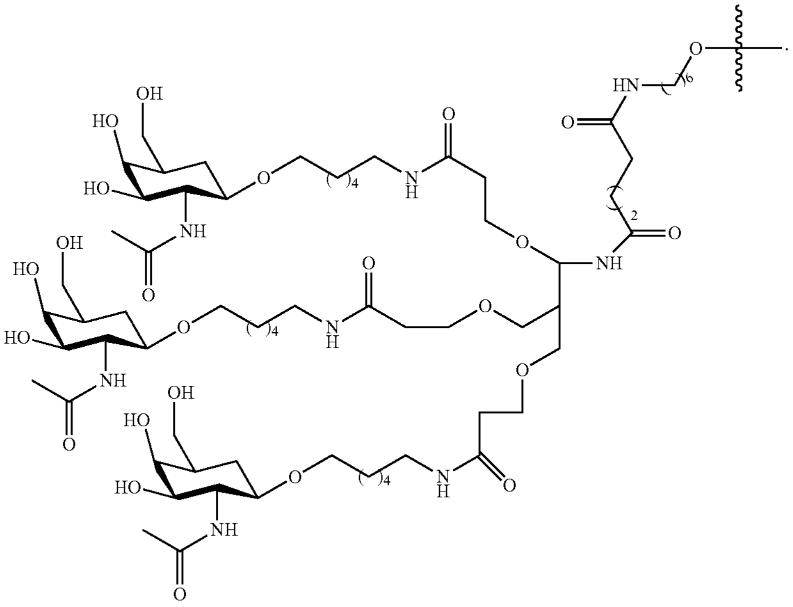

In another embodiment, a carbohydrate conjugate for use in the compositions and methods of the invention is a monosaccharide. In one embodiment, the monosaccharide is an N-acetylgalactosamine, such as Formula I

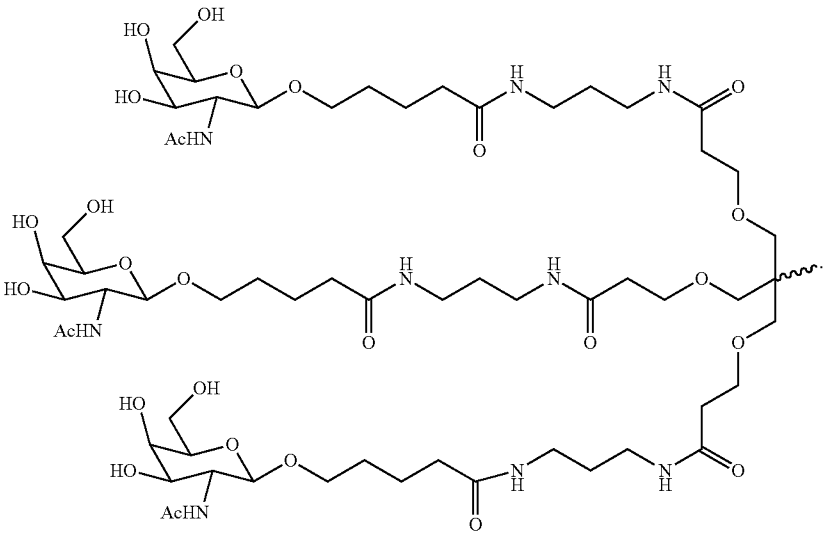

Another representative carbohydrate conjugate for use in the embodiments described herein includes, but is not limited to, (Formula XXXIV)
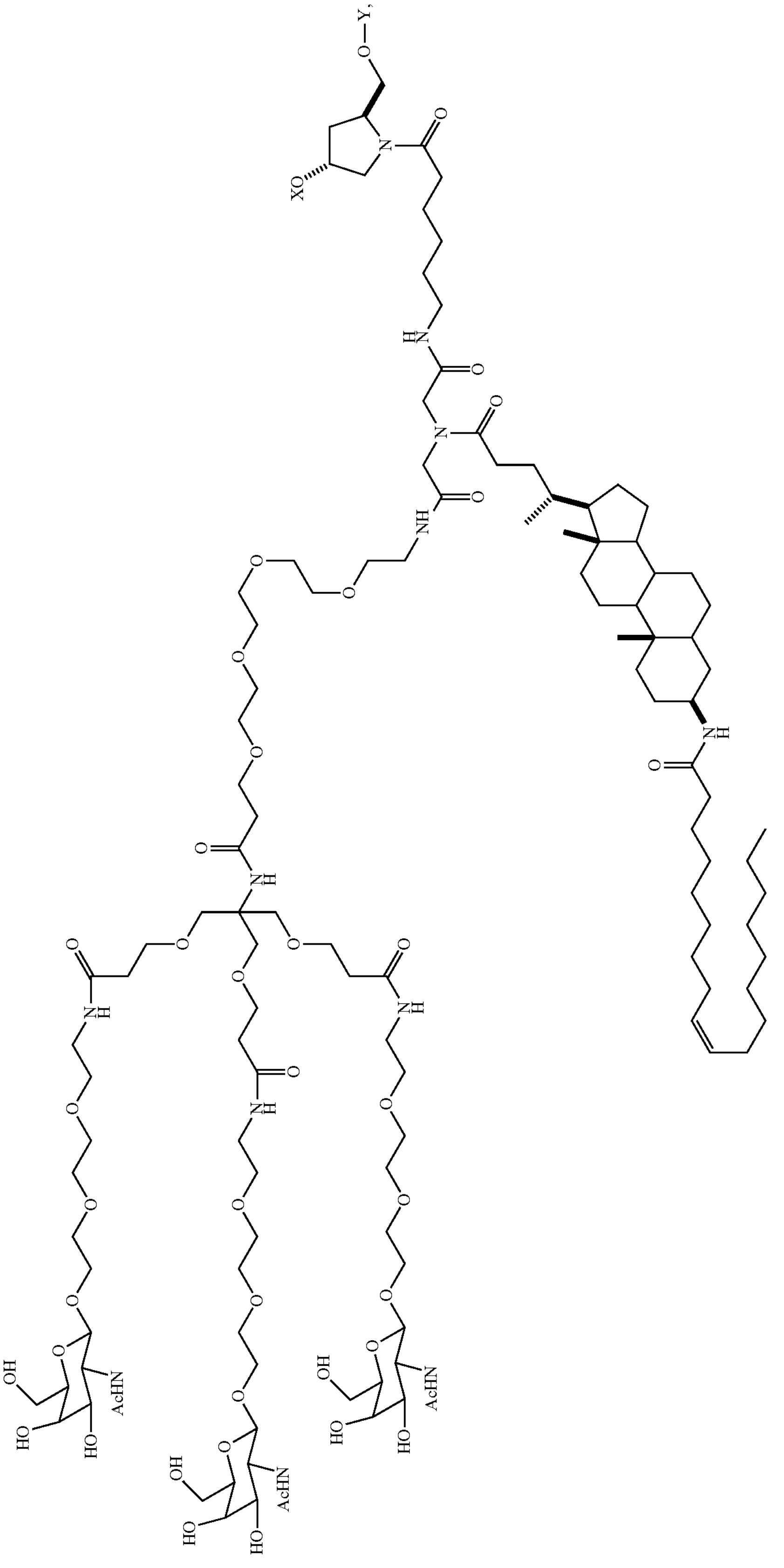

when one of X or Y is an oligonucleotide, the other is a hydrogen.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one GalNAc or GalNAc derivative attached to the iRNA agent, e.g., the 3' or 5'end of the sense strand of a dsRNA agent as described herein. In another embodiment, the double stranded RNAi agents of the invention comprise a plurality (e.g., 2, 3, 4, 5, or 6) of GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator and/or a cell permeation peptide.

Additional carbohydrate conjugates (and linkers) suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term “linker” or “linking group” means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-17, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—.

Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C═NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In one embodiment, an iRNA of the invention is conjugated to a carbohydrate through a linker. Non-limiting examples of iRNA carbohydrate conjugates with linkers of the compositions and methods of the invention include, but are not limited to, Formula XXXV
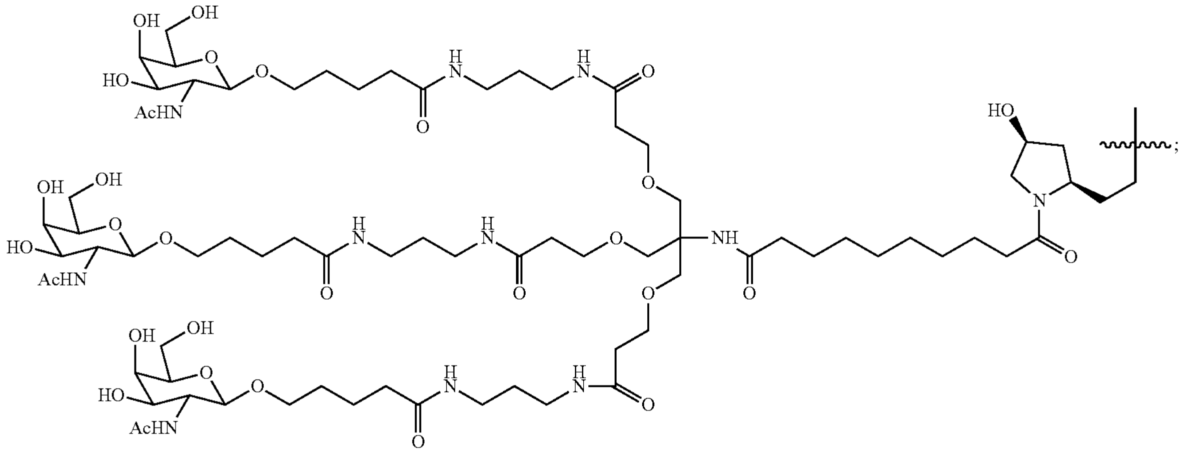
Formula XXXVI
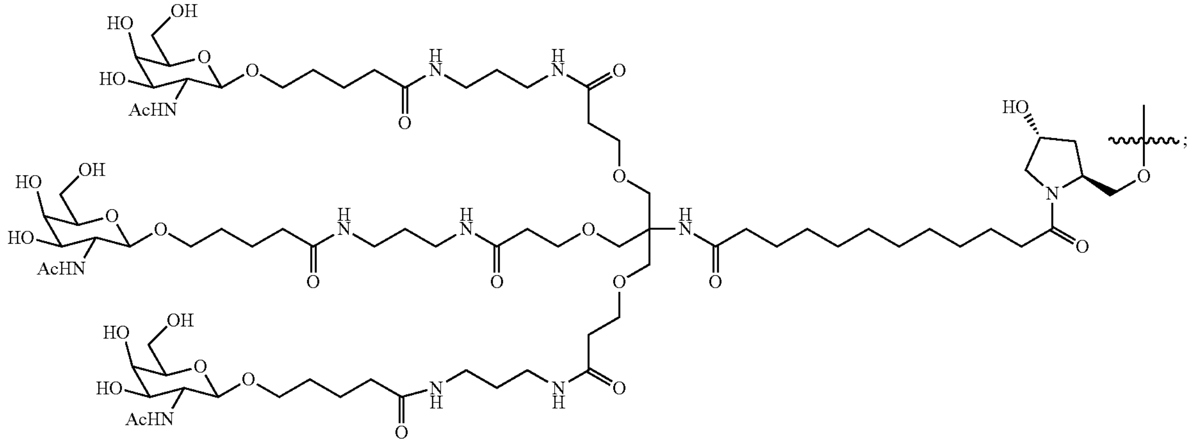
Formula XXXVII
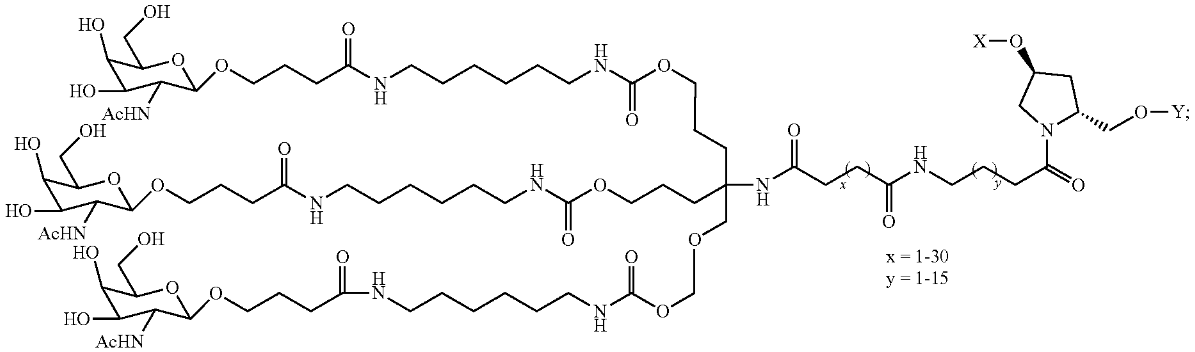
x = 1-30
y = 1-15
Formula XXXVIII
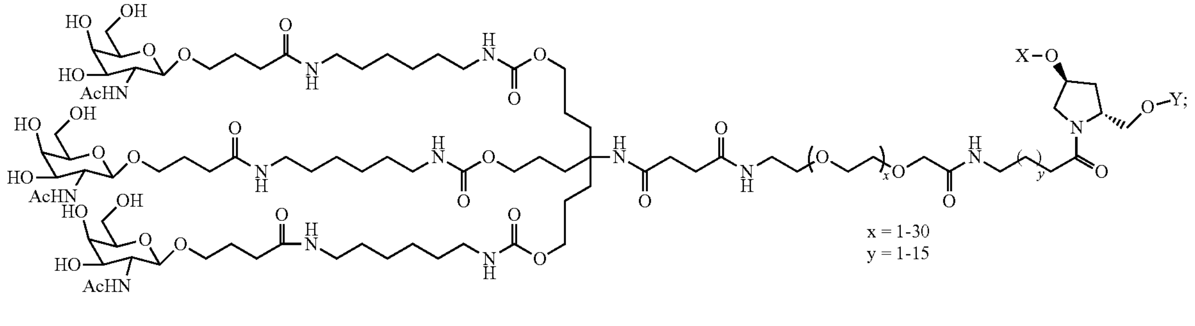
x = 1-30
y = 1-15

-continued

Formula XXXIX

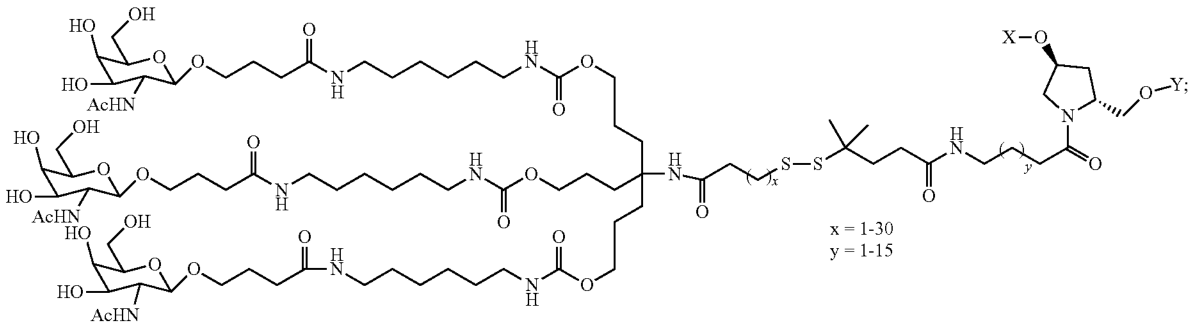

x = 1-30
y = 1-15

Formula XL

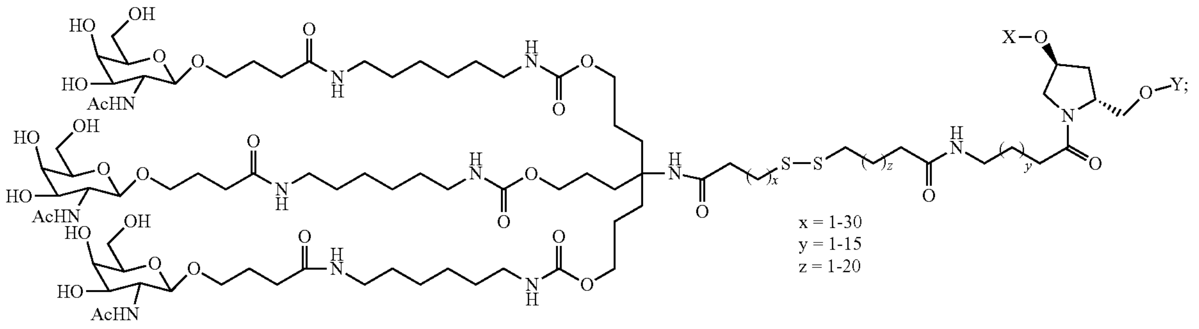

x = 1-30
y = 1-15
z = 1-20

Formula XLI

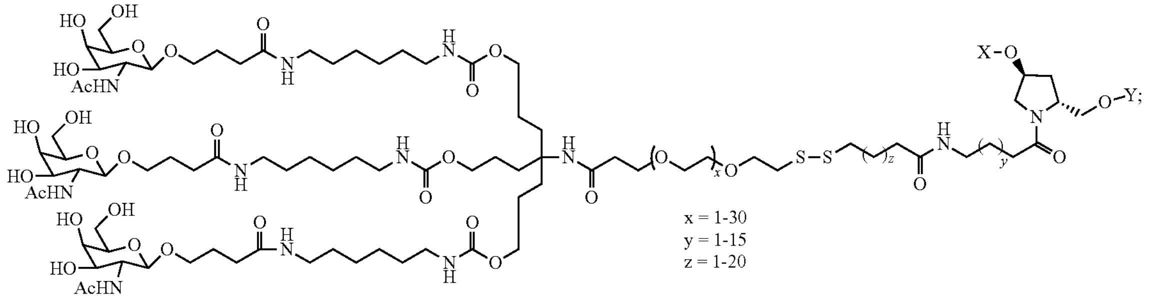

x = 1-30
y = 1-15
z = 1-20 and

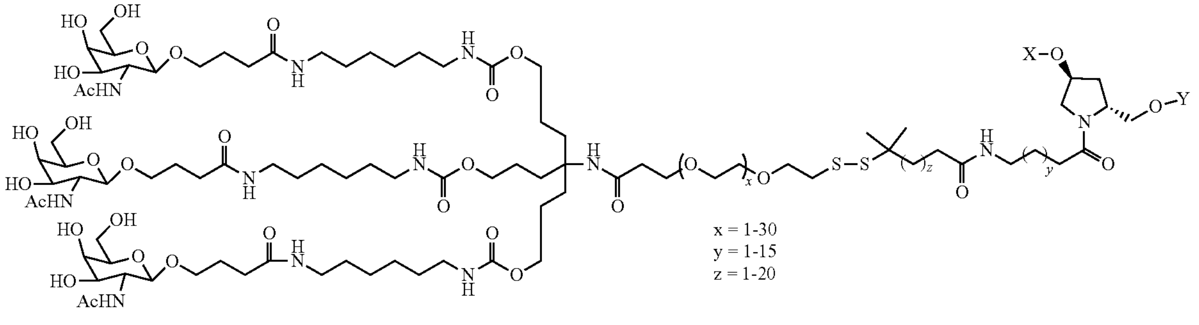

x = 1-30
y = 1-15
z = 1-20

Formula XLII, when one of X or Y is an oligonucleotide, the other is a hydrogen.

In certain embodiments of the compositions and methods of the invention, a ligand is one or more GalNAc (N-acetyl-galactosamine) derivatives attached through a bivalent or trivalent branched linker.

In one embodiment, a dsRNA of the invention is conjugated to a bivalent or trivalent branched linker selected from the group of structures shown in any of formula (XLIII)-(XLVI):

Formula XLIII

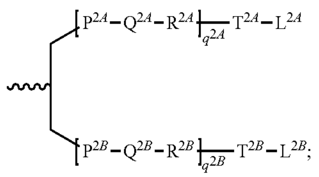

-continued

Formula XLIV

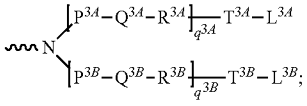

Formula XLV

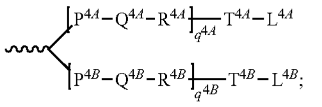

Formula XLVI

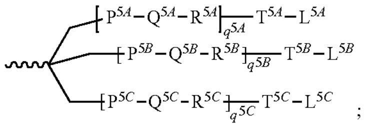

wherein:

$q^2A$, $q^2B$, $q^3A$, $q^3B$, $q^4A$, $q^4B$, $q^5A$, $q^5B$ and $q^5C$ represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')═C(R''), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, —C(O)—$CH(R^a)$—NH—, CO, CH═N—O,

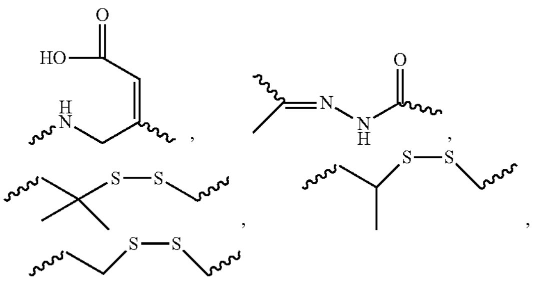

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

Formula XLVII

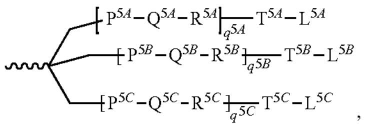

wherein $L^{5A}$ $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas I, VI, IX, X, and XII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111;

Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

V. Delivery of an iRNA of the Invention

The delivery of an iRNA of the invention to a cell e.g., a cell within a subject, such as a human subject (e.g., a subject in need thereof, such as a subject having a disorder of lipid metabolism) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L., (1992) Trends Cell. Biol. 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J. et al., (2004) *Retina* 24:132-138) and subretinal injections in mice (Reich, S J. et al. (2003) *Mol. Vis.* 9:210-216) were both shown to prevent neovascularization in an experimental model of age-related macular degeneration. In addition, direct intratumoral injection of a dsRNA in mice reduces tumor volume (Pille, J. et al. (2005) *Mol. Ther.* 11:267-274) and can prolong survival of tumor-bearing mice (Kim, W J. et al., (2006) Mol. Ther. 14:343-

350; Li, S. et al., (2007) *Mol. Ther.* 15:515-523). RNA interference has also shown success with local delivery to the CNS by direct injection (Dorn, G. et al., (2004) *Nucleic Acids* 32:e49; Tan, P H. et al. (2005) *Gene Ther.* 12:59-66; Makimura, H. et al. (2002) *BMC Neurosci.* 3:18; Shishkina, G T., et al. (2004) *Neuroscience* 129:521-528; Thakker, E R., et al. (2004) *Proc. Natl. Acad. Sci. U.S.A.* 101:17270-17275; Akaneya, Y., et al. (2005) *J Neurophysiol.* 93:594-602) and to the lungs by intranasal administration (Howard, K A. et al., (2006) *Mol. Ther.* 14:476-484; Zhang, X. et al., (2004) *J Biol. Chem.* 279:10677-10684; Bitko, V. et al., (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as a C16 ligand or cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J. et al., (2004) *Nature* 432:173-178). Conjugation of an iRNA to an aptamer has been shown to inhibit tumor growth and mediate tumor regression in a mouse model of prostate cancer (McNamara, J O. et al., (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim SH. et al., (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al. (2003) *J. Mol. Biol* 327:761-766; Verma, U N. et al., (2003) *Clin. Cancer Res.* 9:1291-1300; Arnold, A S et al., (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet ME. et al., (2008) *Pharm. Res.* August 16 Epub ahead of print; *Aigner, A.* (2006) *J. Biomed. Biotechnol.* 71659), Arg-Gly-Asp (RGD) peptides (Liu, S. (2006)*Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector encoded iRNAs of the Invention iRNA targeting the GRB10 or GRB14 gene can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively, each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

VI. Pharmaceutical Compositions of the Invention

The present invention also includes pharmaceutical compositions and formulations which include the iRNAs of the invention. Accordingly, in one embodiment, provided herein are pharmaceutical compositions comprising a double stranded ribonucleic acid (dsRNA) agent that inhibits expression of growth factor receptor bound protein 10 (GRB10) in a cell, such as a liver cell, wherein the dsRNA agent comprises a sense strand and an antisense strand, wherein the sense strand comprises at least 15 contiguous nucleotides differing by no more than 1, 2, or 3 nucleotides from the nucleotide sequence of SEQ ID NO: 1, 3, 5, 7, 9, 11, 13, or 15, and said antisense strand comprises at least 15 contiguous nucleotides differing by no more than 1, 2, or 3 nucleotides from the nucleotide sequence of SEQ ID NO: 2, 4, 6, 8, 10, 12, 14, or 16; and a pharmaceutically acceptable carrier. In some embodiments, the dsRNA agent comprises a sense strand and an antisense strand, wherein the sense strand comprises at least 15 contiguous nucleotides from the nucleotide sequence of SEQ ID NO: 1, 3, 5, 7, 9, 11, 13, or 15, and said antisense strand comprises at least 15 contiguous nucleotides from the nucleotide sequence of SEQ ID NO: 2, 4, 6, 8, 10, 12, 14, or 16.

In one embodiment, provided herein are pharmaceutical compositions comprising a double stranded ribonucleic acid (dsRNA) agent that inhibits expression of growth factor receptor bound protein 14 (GRB14) in a cell, such as a liver cell, wherein the dsRNA agent comprises a sense strand and an antisense strand, wherein the sense strand comprises at least 15 contiguous nucleotides differing by no more than 1, 2, or 3 nucleotides from the nucleotide sequence of SEQ ID NO: 29 or 31, and said antisense strand comprises at least 15 contiguous nucleotides differing by no more than 1, 2, or 3 nucleotides from the nucleotide sequence of SEQ ID NO: 30 or 32; and a pharmaceutically acceptable carrier. In some embodiments, the dsRNA agent comprises a sense strand and an antisense strand, wherein the sense strand comprises at least 15 contiguous nucleotides from the nucleotide sequence of SEQ ID NO: 29 or 31, and said antisense strand comprises at least 15 contiguous nucleotides from the nucleotide sequence of SEQ ID NO: 30 or 32.

In another embodiment, provided herein are pharmaceutical compositions comprising a dsRNA agent that inhibits expression of growth factor receptor bound protein 10 (GRB10) or growth factor receptor bound protein 14 (GRB14) in a cell, such as a liver cell, wherein the dsRNA agent comprises a sense strand and an antisense strand, the antisense strand comprising a region of complementarity which comprises at least 15 contiguous nucleotides differing by no more than 1, 2, or 3 nucleotides from any one of the antisense sequences listed in Tables 3-10; and a pharmaceutically acceptable carrier. In some embodiments, the dsRNA agent comprises a sense strand and an antisense strand, the antisense strand comprising a region of complementarity which comprises at least 15 contiguous nucleotides from any one of the antisense sequences listed in Tables 3-10.

The pharmaceutical compositions containing the iRNA of the invention are useful for treating a disease or disorder associated with the expression or activity of a GRB10 or GRB14 gene, e.g., diabetes. Such pharmaceutical compositions are formulated based on the mode of delivery. One example is compositions that are formulated for systemic administration via parenteral delivery, e.g., by intravenous (IV), intramuscular (IM) or for subcutaneous delivery. Another example is compositions that are formulated for direct delivery into the liver, e.g., by infusion into the liver, such as by continuous pump infusion. The pharmaceutical compositions of the invention may be administered in dosages sufficient to inhibit expression of a GRB10 or GRB14 gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, preferably about 0.3 mg/kg and about 3.0 mg/kg. A repeat-dose regimen may include administration of a therapeutic amount of iRNA on a regular basis, such as every other day to once a year. In certain embodiments, the iRNA is administered about once per week, once every 7-10 days, once every 2 weeks, once every 3 weeks, once every 4 weeks, once every 5 weeks, once every 6 weeks, once every 7 weeks, once every 8 weeks, once every 9 weeks, once every 10 weeks, once every 11 weeks, once every 12 weeks, once per month, once every 2 months, once every 3 months (once per quarter), once every 4 months, once every 5 months, or once every 6 months.

After an initial treatment regimen, the treatments can be administered on a less frequent basis.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

Advances in mouse genetics have generated a number of mouse models for the study of various human diseases, such as a GRB10- or GRB14-associated disease, disorder, or condition that would benefit from reduction in the expression of GRB10 or GRB14, including type 2 diabetes, obesity, and obesity-associated disorders. Such models can be used for in vivo testing of RNAi agents, as well as for determining a therapeutically effective dose. Suitable rodent models are known in the art and include, for example, those described in, for example, Lutz and Woods (2012) Curr. Protoc. Pharmacol. Chapter: Unit 5.61; Barrett, et al., (2016) Disease Models and Mechanisms, 9:1245-55; and Xie, et al. (2014) *PLoS ONE* 9(9): e108559 (streptozotocin-induced diabetic mice). Many experimental type 2 diabetes animal models have been established from spontaneous mutants, and transgenic GRB10 mice have been proposed as a new animal model for non-obese type 2 diabetes. (Yamamoto, et al., (2008) Exp. Anim. 57(4):385-395). Such models can be used for in vivo testing of iRNA, as well as for determining a therapeutically effective dose. Additional mouse models that may be relevant to GRB10 or GRB14 research are known in the art and include, for example, mice and rats fed a high fat diet (HFD; also referred to as a Western diet), a methionine-choline deficient (MCD) diet, or a high-fat (15%), high-cholesterol (1%) diet (HFHC), an obese (ob/ob) mouse containing a mutation in the obese (ob) gene (Wiegman et al., (2003) Diabetes, 52:1081-1089); a mouse containing homozygous knock-out of an LDL receptor (LDLR−/− mouse; Ishibashi et al., (1993) J Clin Invest 92(2):883-893); diet-induced artherosclerosis mouse model (Ishida et al., (1991) J. Lipid. Res., 32:559-568); heterozygous lipoprotein lipase knockout mouse model (Weistock et al., (1995) J. Clin. Invest. 96(6):2555-2568); mice and rats fed a choline-deficient, L-amino acid-defined, high-fat diet (CDAHFD) (Matsumoto et al. (2013) Int. J. Exp. Path. 94:93-103); mice and rats fed a high-trans-fat, cholesterol diet (HTF-C) (Clapper et al. (2013) Am. J. Physiol. Gastrointest. Liver Physiol. 305:G483-G495); mice and rats fed a high-fat, high-cholesterol, bile salt diet (HF/HC/BS) (Matsuzawa et al. (2007) Hepatology 46:1392-1403); and mice and rats fed a high-fat diet+fructose (30%) water (Softic et al. (2018) J. Clin. Invest. 128(1)-85-96).

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular cell or tissue, such as the liver (e.g., the hepatocytes of the liver).

In some embodiments, the pharmaceutical compositions of the invention are suitable for intramuscular administration to a subject. In other embodiments, the pharmaceutical compositions of the invention are suitable for intravenous administration to a subject. In some embodiments of the invention, the pharmaceutical compositions of the invention are suitable for subcutaneous administration to a subject, e.g., using a 29 g or 30 g needle.

The pharmaceutical compositions of the invention may include an RNAi agent of the invention in an unbuffered solution, such as saline or water, or in a buffer solution, such as a buffer solution comprising acetate, citrate, prolamine, carbonate, or phosphate or any combination thereof.

In one embodiment, the pharmaceutical compositions of the invention, e.g., such as the compositions suitable for subcutaneous administration, comprise an RNAi agent of the invention in phosphate buffered saline (PBS). Suitable concentrations of PBS include, for example, 1 mM, 1.5 mM, 2 mM, 2.5 mM, 3 mM, 3.5 mM, 4 mM, 4.5 mM, 5 mM, 6.5 mM, 7 mM, 7.5 mM, 9 mM, 8.5 mM, 9 mM, 9.5 mM, or about 10 mM PBS. In one embodiment of the invention, a pharmaceutical composition of the invention comprises an RNAi agent of the invention dissolved in a solution of about 5 mM PBS (e.g., 0.64 mM $NaH_2PO_4$, 4.36 mM $Na_2HPO_4$, 85 mM NaCl). Values intermediate to the above recited ranges and values are also intended to be part of this invention. In addition, ranges of values using a combination of any of the above recited values as upper and/or lower limits are intended to be included.

The pH of the pharmaceutical compositions of the invention may be between about 5.0 to about 8.0, about 5.5 to about 8.0, about 6.0 to about 8.0, about 6.5 to about 8.0, about 7.0 to about 8.0, about 5.0 to about 7.5, about 5.5 to about 7.5, about 6.0 to about 7.5, about 6.5 to about 7.5, about 5.0 to about 7.2, about 5.25 to about 7.2, about 5.5 to about 7.2, about 5.75 to about 7.2, about 6.0 to about 7.2, about 6.5 to about 7.2, or about 6.8 to about 7.2. Ranges and values intermediate to the above recited ranges and values are also intended to be part of this invention.

The osmolality of the pharmaceutical compositions of the invention may be suitable for subcutaneous administration, such as no more than about 400 mOsm/kg, e.g., between 50 and 400 mOsm/kg, between 75 and 400 mOsm/kg, between 100 and 400 mOsm/kg, between 125 and 400 mOsm/kg, between 150 and 400 mOsm/kg, between 175 and 400 mOsm/kg, between 200 and 400 mOsm/kg, between 250 and 400 mOsm/kg, between 300 and 400 mOsm/kg, between 50 and 375 mOsm/kg, between 75 and 375 mOsm/kg, between 100 and 375 mOsm/kg, between 125 and 375 mOsm/kg, between 150 and 375 mOsm/kg, between 175 and 375 mOsm/kg, between 200 and 375 mOsm/kg, between 250 and 375 mOsm/kg, between 300 and 375 mOsm/kg, between 50 and 350 mOsm/kg, between 75 and 350 mOsm/kg, between 100 and 350 mOsm/kg, between 125 and 350 mOsm/kg, between 150 and 350 mOsm/kg, between 175 and 350 mOsm/kg, between 200 and 350 mOsm/kg, between 250 and 350 mOsm/kg, between 50 and 325 mOsm/kg, between 75 and 325 mOsm/kg, between 100 and 325 mOsm/kg, between 125 and 325 mOsm/kg, between 150 and 325 mOsm/kg, between 175 and 325 mOsm/kg, between 200 and 325 mOsm/kg, between 250 and 325 mOsm/kg, between 300 and 325 mOsm/kg, between 300 and 350 mOsm/kg, between 50 and 300 mOsm/kg, between 75 and 300 mOsm/kg, between 100 and 300 mOsm/kg, between 125 and 300 mOsm/kg, between 150 and 300 mOsm/kg, between 175 and 300 mOsm/kg, between 200 and 300 mOsm/kg, between 250 and 300, between 50 and 250 mOsm/kg, between 75 and 250 mOsm/kg, between 100 and 250 mOsm/kg, between 125 and 250 mOsm/kg, between 150 and 250 mOsm/kg, between 175 and 350 mOsm/kg, between 200 and 250 mOsm/kg, e.g., about 50, 55, 60, 65, 70, 75, 80, 85, 90, 95, 100, 105, 110, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 295, 300, 305, 310, 320, 325, 330, 335, 340, 345, 350, 355, 360, 365, 370, 375, 380, 385, 390, 395, or about 400 mOsm/kg. Ranges and values intermediate to the above recited ranges and values are also intended to be part of this invention.

The pharmaceutical compositions of the invention comprising the RNAi agents of the invention, may be present in a vial that contains about 0.5, 0.6, 0.7, 0.8, 0.9, 1.0, 1.1, 1.2, 1.3, 1.4, 1.5, 1.6, 1.7, 1.8, 1.9, or about 2.0 mL of the pharmaceutical composition. The concentration of the RNAi agents in the pharmaceutical compositions of the invention may be about 10, 15, 20, 25, 30, 35, 40, 45, 50, 55, 60, 65, 70, 75, 80, 85, 90, 95, 100, 105, 110, 115, 130, 125, 130, 135, 140, 145, 150, 175, 180, 185, 190, 195, 200, 205, 210, 215, 230, 225, 230, 235, 240, 245, 250, 275, 280, 285, 290, 295, 300, 305, 310, 315, 330, 325, 330, 335, 340, 345, 350, 375, 380, 385, 390, 395, 400, 405, 410, 415, 430, 425, 430, 435, 440, 445, 450, 475, 480, 485, 490, 495, or about 500 mg/mL. In one embodiment, the concentration of the RNAi agents in the pharmaceutical compositions of the invention is about 100 mg/mL. Values intermediate to the above recited ranges and values are also intended to be part of this invention.

The pharmaceutical compositions of the invention may comprise a dsRNA agent of the invention in a free acid form. In other embodiments of the invention, the pharmaceutical compositions of the invention may comprise a dsRNA agent of the invention in a salt form, such as a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcamitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes include unilamellar or multilamellar vesicles which have a membrane formed from a lipophilic material and an aqueous interior. The aqueous portion contains the composition (e.g., iRNA) to be delivered. The lipophilic material isolates the aqueous interior from an aqueous exterior, which typically does not include the iRNA composition, although in some examples, it may. Cationic liposomes possess the advantage of being able to fuse to the cell wall. Non-cationic liposomes, although not able to fuse as efficiently with the cell wall, are taken up by macrophages in vivo.

In order to traverse intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis.

A liposome containing an iRNA agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The iRNA agent preparation is then added to the micelles that include the lipid component. The cationic groups on the lipid interact with the iRNA agent and condense around the iRNA agent to form a liposome. After condensation, the detergent is removed, e.g., by dialysis, to yield a liposomal preparation of iRNA agent.

If necessary a carrier compound that assists in condensation can be added during the condensation reaction, e.g., by controlled addition. For example, the carrier compound can be a polymer other than a nucleic acid (e.g., spermine or spermidine). pH can also be adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., Proc. Natl. Acad. Sci., USA 8:7413-7417, 1987; U.S. Pat. Nos. 4,897,355; 5,171,678; Bangham, et al. M. Mol. Biol. 23:238, 1965; Olson, et al. Biochim. Biophys. Acta 557:9, 1979; Szoka, et al. Proc. Natl. Acad. Sci. 75: 4194, 1978; Mayhew, et al. Biochim. Biophys. Acta 775:169, 1984; Kim, et al. Biochim. Biophys. Acta 728:339, 1983; and Fukunaga, et al. Endocrinol. 115:757, 1984. Commonly used techniques for preparing lipid aggregates of appropriate size for use as delivery vehicles include sonication and freeze-thaw plus extrusion (see, e.g., Mayer, et al. Biochim. Biophys. Acta 858:161, 1986). Microfluidization can be used when consistently small (50 to 200 nm) and relatively uniform aggregates are desired (Mayhew, et al. Biochim. Biophys. Acta 775:169, 1984). These methods are readily adapted to packaging iRNA agent preparations into liposomes.

Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.,* 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., *Journal of Controlled Release,* 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185 and 5,171,678; WO 94/00569; WO 93/24640; WO 91/16024; Felgner, J. Biol. Chem. 269:2550, 1994; Nabel, Proc. Natl. Acad. Sci. 90:11307, 1993; Nabel, Human Gene Ther. 3:649, 1992; Gershon, Biochem. 32:7143, 1993; and Strauss EMBO J. 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P. *Pharma. Sci.,* 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters,* 1987, 223, 42; Wu et al., *Cancer Research,* 1993, 53, 3765).

Various liposomes comprising one or more glycolipids are known in the art. Papahadjopoulos et al. (*Ann. N. Y. Acad. Sci.,* 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.,* 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In some embodiments, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver iRNA agents to macrophages.

Further advantages of liposomes include: liposomes obtained from natural phospholipids are biocompatible and biodegradable; liposomes can incorporate a wide range of water and lipid soluble drugs; liposomes can protect encapsulated iRNAs in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size, and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of iRNA agent (see, e.g., Felgner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ (Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis (oleoyloxy)-3,3-(trimethylammonia)propane ("DOTAP") (Boehringer Mannheim, Indianapolis, Indiana) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wisconsin) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, California) and Lipofectamine™ (DOSPA) (Life Technology, Inc., Gaithersburg, Maryland). Other cationic lipids suitable for the delivery of oligonucleotides are described in WO 98/39359 and WO 96/37194.

Liposomal formulations are particularly suited for topical administration. Liposomes present several advantages over other formulations. Such advantages include reduced side effects related to high systemic absorption of the administered drug, increased accumulation of the administered drug at the desired target, and the ability to administer iRNA agent into the skin. In some implementations, liposomes are used for delivering iRNA agent to epidermal cells and also to enhance the penetration of iRNA agent into dermal tissues, e.g., into skin. For example, the liposomes can be applied topically. Topical delivery of drugs formulated as liposomes to the skin has been documented (see, e.g., Weiner et al., Journal of Drug Targeting, 1992, vol. 2, 405-410 and du Plessis et al., Antiviral Research, 18, 1992, 259-265; Mannino, R. J. and Fould-Fogerite, S., Biotechniques 6:682-690, 1988; Itani, T. et al. Gene 56:267-276.1987; Nicolau, C. et al. Meth. Enz. 149:157-176, 1987; Straubinger, R. M. and Papahadjopoulos, D. Meth. Enz. 101:512-527, 1983; Wang, C. Y. and Huang, L., Proc. Natl. Acad. Sci. USA 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver a drug into the dermis of mouse skin. Such formulations with iRNA agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include iRNAs can be delivered, for example, subcutaneously by infection in order to deliver iRNAs to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in WO 2008/042973.

Transfersomes are yet another type of liposomes and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of iRNA, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the RNAi and at least the alkali metal alkyl sulphate. The first micellar composition is then mixed with at least three micelle forming compounds to form a mixed micellar composition. In another method, the micellar composition is prepared by mixing the RNAi, the alkali metal alkyl sulphate and at least one of the micelle forming compounds, followed by addition of the remaining micelle forming compounds, with vigorous mixing.

Phenol or m-cresol may be added to the mixed micellar composition to stabilize the formulation and protect against bacterial growth. Alternatively, phenol or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNA agents of in the invention may be fully encapsulated in a lipid formulation, e.g., an LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). As used herein, the term "SPLP" refers to a nucleic acid-lipid particle comprising plasmid DNA encapsulated within a lipid vesicle. LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In certain embodiments, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid may be, for example, N,N-dioleyl-N, N-dimethylammonium chloride (DODAC), N,N-distearyl-N,N-dimethylammonium bromide (DDAB), N—(I-(2,3-dioleoyloxy)propyl)-N,N,N-trimethylammonium chloride (DOTAP), N—(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1), or a mixture thereof. The cationic lipid may comprise from about 20 mol % to about 50 mol % or about 40 mol % of the total lipid present in the particle.

In certain embodiments, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In certain embodiments, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethylene glycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($Ci_2$), a PEG-dimyristyloxypropyl ($Ci_4$), a PEG-dipalmityloxypropyl ($Ci_6$), or a PEG-distearyloxypropyl ($C]_8$). The conjugated lipid that prevents aggregation of particles may be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

LNP01

In certain embodiments, the lipidoid ND98·4HCl (MW 1487) (see U.S. patent application Ser. No. 12/056,230, filed Mar. 26, 2008, which is herein incorporated by reference), Cholesterol (Sigma-Aldrich), and PEG-Ceramide C16 (Avanti Polar Lipids) can be used to prepare lipid-dsRNA nanoparticles (e.g., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

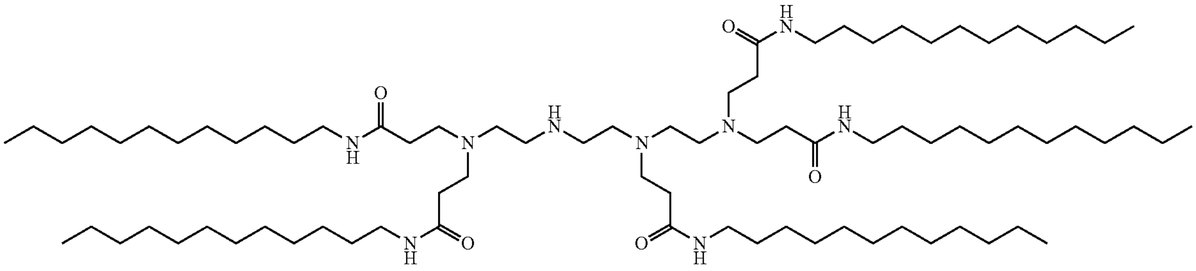

ND98 Isomer I

LNP01 formulations are described, e.g., in International Application Publication No. WO 2008/042973, which is hereby incorporated by reference.

Additional exemplary lipid-dsRNA formulations are provided in the following table.

TABLE 1

Exemplary lipid formulations

| | Cationic Lipid | cationic lipid/non-cationic lipid/cholesterol/PEG-lipid conjugate Lipid:siRNA ratio |
|---|---|---|
| SNALP | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| S-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | X7TC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200) | C12-200/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG |

TABLE 1-continued

| | Exemplary lipid formulations | |
|---|---|---|
| | Cationic Lipid | cationic lipid/non-cationic lipid/cholesterol/PEG-lipid conjugate Lipid:siRNA ratio |
| | | 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine

DPPC: dipalmitoylphosphatidylcholine

PEG-DMG: PEG-didimyristoyl glycerol (C14-PEG, or PEG-C14) (PEG with avg mol wt of 2000)

PEG-DSG: PEG-distyryl glycerol (C18-PEG, or PEG-C18) (PEG with avg mol wt of 2000)

PEG-cDMA: PEG-carbamoyl-1,2-dimyristyloxypropylamine (PEG with avg mol wt of 2000)

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Ser. No. 61/185,712, filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 comprising formulations are described, e.g., in U.S. Provisional Ser. No. 61/244,834, filed Sep. 22, 2009, U.S. Provisional Ser. No. 61/185,800, filed Jun. 10, 2009, and International Application No. PCT/US10/28224, filed Jun. 10, 2010, which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in U.S. Provisional Ser. No. 61/175,770, filed May 5, 2009 and International Application No. PCT/US10/33777, filed May 5, 2010, which are hereby incorporated by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publication. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient (s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

Many liposomes comprising lipids derivatized with one or more hydrophilic polymers, and methods of preparation thereof, are known in the art. Sunamoto et al. (*Bull. Chem. Soc. Jpn.,* 1980, 53, 2778) described liposomes comprising a nonionic detergent, $2C_{125G}$, that contains a PEG moiety. Illum et al. (*FEBS Lett.,* 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (*FEBS Lett.,* 1990, 268, 235) described experiments demonstrating that liposomes comprising phosphatidylethanolamine (PE) derivatized with PEG or PEG stearate have significant increases in blood circulation half-lives. Blume et al. (*Biochimica et Biophysica Acta,* 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.). Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

C. Additional Formulations i. Emulsions

The compositions of the present invention can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise, a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & *Wilkins* (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically, microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (M0310), hexaglycerol monooleate (P0310), hexaglycerol pentaoleate (P0500), decaglycerol monocaprate (MCA750), decaglycerol monooleate (M0750), decaglycerol sequioleate (S0750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An RNAi agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, NY, 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, MA, 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, NY, 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, NY, 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, M A, 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of iRNAs at the cellular level can also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, CA), Lipofectamine 2000™ (Invitrogen; Carlsbad, CA), 293Fectin™ (Invitrogen; Carlsbad, CA), Cellfectin™ (Invitrogen; Carlsbad, CA), DMRIE-C™ (Invitrogen; Carlsbad, CA), FreeStyle™ MAX (Invitrogen; Carlsbad, CA), Lipofectamine™ 2000 CD (Invitrogen; Carlsbad, CA), Lipofectamine™ (Invitrogen; Carlsbad, CA), RNAiMAX (Invitrogen; Carlsbad, CA), Oligofectamine™ (Invitrogen; Carlsbad, CA), Optifect™ (Invitrogen; Carlsbad, CA), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, WI), TransFast™ Transfection Reagent (Promega; Madison, WI), Tfx™-20 Reagent (Promega; Madison, WI), Tfx™-50 Reagent (Promega; Madison, WI), DreamFect™ (OZ Biosciences; Marseille, France), EcoTransfect (OZ Biosciences; Marseille, France), TransPass[a] D1 Transfection Reagent (New England Biolabs; Ipswich, MA, USA), LyoVec™/LipoGen™ (Invitrogen; San Diego, CA, USA), PerFectin Transfection Reagent (Genlantis; San Diego, CA, USA), NeuroPORTER Transfection Reagent (Genlantis; San Diego, CA, USA), GenePORTER Transfection reagent (Genlantis; San Diego, CA, USA), GenePORTER 2 Transfection reagent (Genlantis; San Diego, CA, USA), Cytofectin Transfection Reagent (Genlantis; San Diego, CA, USA), BaculoPORTER Transfection Reagent (Genlantis; San Diego, CA, USA), TroganPORTER™ transfection Reagent (Genlantis; San Diego, CA, USA), RiboFect (Bioline; Taunton, MA, USA), PlasFect (Bioline; Taunton, MA, USA), UniFECTOR (B-Bridge International; Mountain View, CA, USA), SureFECTOR (B-Bridge International; Mountain View, CA, USA), or HiFect™ (B-Bridge International, Mountain View, CA, USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the disclosure include (a) one or more RNAi agents and (b) one or more agents which function by a non-RNAi mechanism and which are useful in treating a GRB10- or GRB14-associated disorder, e.g., type 1 diabetes, type 2 diabetes, prediabetes, insulin resistance, or diabetes-related conditions such as obesity, diabetic neuropathy, diabetic nephropathy, diabetic vasculopathy, diabetic retinopathy, hypertension, dyslipidemia, atherosclerosis, coronary heart disease, stroke, etc. Examples of such agents include, but are not limited to, insulin (e.g., insulin detemir (Levemir), insulin glargine (Lantus)), Metformin (Glucophage), sulfonylureas, thiazolidinediones, dipeptidyl peptidase-4 inhibitors, SGLT2 inhibitors, glucagon-like peptide-1 analogs, angiotensin converting enzyme inhibitors (ACEIs), angiotensin receptor blockers (ARBs), Aliskiren (Tekturna, Rasilez), corticosteroids, protease inhibitors, orlistat (Alli, Xenical), phentermine and topiramate (Qsymia), bupropion and naltrexone (Contrave), liraglutide (Saxenda, Victoza), agents that decrease or otherwise affect the GRB10 or GRB14 activity, or agents that independently contribute to amelioration of symptoms and improvement of patients having a GRB10- or GRB14-associated disorder.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the $ED_{50}$ with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by GRB10 or GRB14 expression. In any event, the administering physician can adjust the amount and timing of iRNA administration on the basis of results observed using standard measures of efficacy known in the art or described herein.

Synthesis of Cationic Lipids:

Any of the compounds, e.g., cationic lipids and the like, used in the nucleic acid-lipid particles featured in the invention may be prepared by known organic synthesis techniques. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tert-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms may be optionally oxidized, and the nitrogen heteroatom may be optionally quaternized, including bicyclic rings in which any of the above heterocycles are fused to a benzene ring. The heterocycle may be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydroprimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted heterocycle" means that, when substituted, at least one hydrogen atom is replaced with a substituent. In the case of an oxo substituent (=O) two hydrogen atoms are replaced. In this regard, substituents include oxo, halogen, heterocycle, —CN, —$OR^x$, —$NR^xR^y$, —$NR^xC(=O)R^y$, —$NR^xSO_2R^y$, —$C(=O)R^x$, —$C(=O)OR^x$, —$C(=O)NR^xR^y$, —$SO_nR^x$ and —$SO_nNR^xR^y$, wherein n is 0, 1 or 2, $R^x$ and $R^y$ are the same or different and independently hydrogen, alkyl or heterocycle, and each of said alkyl and heterocycle substituents may be further substituted with one or more of oxo, halogen, —OH, —CN, alkyl, —$OR^x$, heterocycle, —$NR^xR^y$, —$NR^xC(=O)R^y$, —$NR^xSO_2R^y$, —$C(=O)R^x$, —$C(=O)OR^x$, —$C(=O)NR^xR^y$, —$SO_nR^x$ and —$SO_n$-$NR^xR^y$.

"Halogen" means fluoro, chloro, bromo and iodo.

In some embodiments, the methods featured in the invention may require the use of protecting groups. Protecting group methodology is well known to those skilled in the art (see, for example, Protective Groups in Organic Synthesis, Green, T. W. et al., Wiley-Interscience, New York City, 1999). Briefly, protecting groups within the context of this invention are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of Formula A:

In certain embodiments, nucleic acid-lipid particles featured in the invention are formulated using a cationic lipid of formula A:

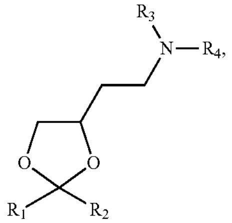

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments, the cationic lipid is XTC (2,2-Dilinoleyl-4-dimethylaminoethyl-[1,3]-dioxolane). In general, the lipid of formula A above may be made by the following Reaction Schemes 1 or 2, wherein all substituents are as defined above unless indicated otherwise.

Scheme 1

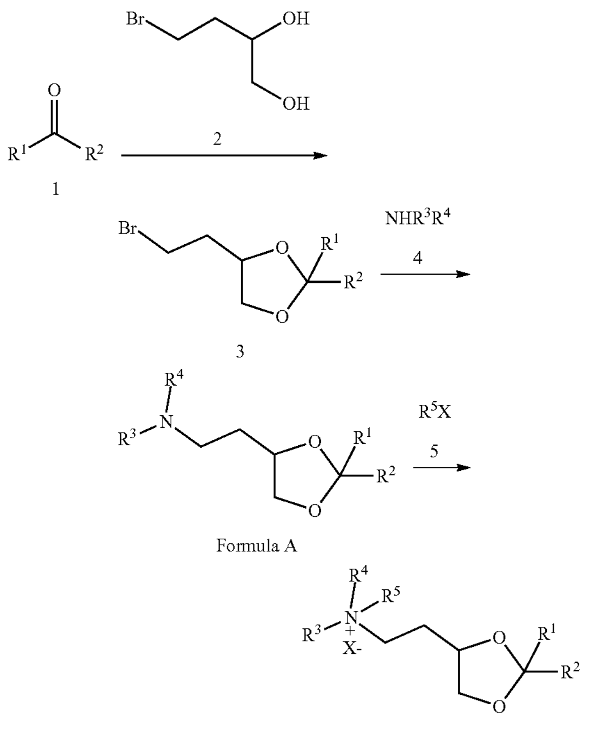

1

3

Formula A

Lipid A, where $R_1$ and $R_2$ are independently alkyl, alkenyl or alkynyl, each can be optionally substituted, and $R_3$ and $R_4$ are independently lower alkyl or $R_3$ and $R_4$ can be taken together to form an optionally substituted heterocyclic ring, can be prepared according to Scheme 1. Ketone 1 and bromide 2 can be purchased or prepared according to methods known to those of ordinary skill in the art. Reaction of 1 and 2 yields ketal 3. Treatment of ketal 3 with amine 4 yields lipids of formula A. The lipids of formula A can be converted to the corresponding ammonium salt with an organic salt 5, where X is anion counter ion selected from halogen, hydroxide, phosphate, sulfate, or the like.

Scheme 2

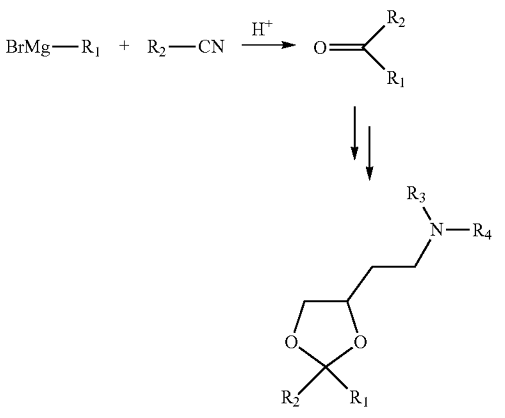

Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of MC3:

Preparation of DLin-M-C3-DMA (i.e., (6Z,9Z,28Z,31Z)-heptatriaconta-6,9,28,31-tetraen-19-yl 4-(dimethylamino) butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient. Fractions containing the purified product were combined and the solvent removed, yielding a colorless oil (0.54 g).

Synthesis of ALNY-100:

Synthesis of ketal 519 [ALNY-100] was performed using the following scheme 3:

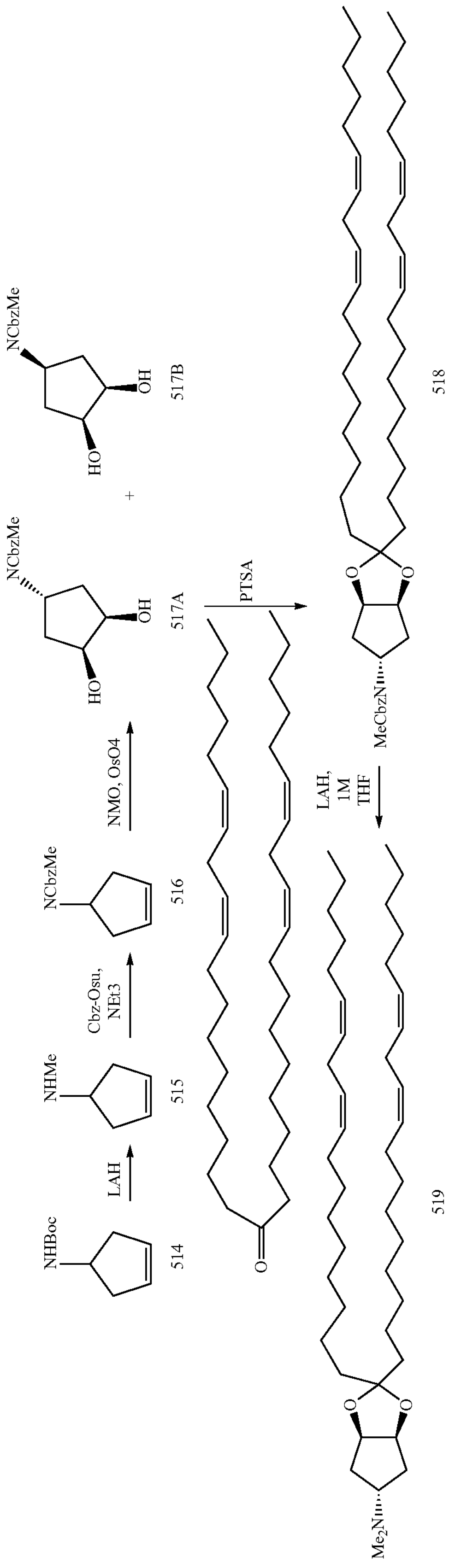
514 515 516 517A + 517B
518
519

Synthesis of 515:

To a stirred suspension of LiAlH4 (3.74 g, 0.09852 mol) in 200 ml anhydrous THF in a two neck RBF (1 L), was added a solution of 514 (10 g, 0.04926 mol) in 70 mL of THF slowly at 0° C. under nitrogen atmosphere. After complete addition, reaction mixture was warmed to room temperature and then heated to reflux for 4 h. Progress of the reaction was monitored by TLC. After completion of reaction (by TLC) the mixture was cooled to 0° C. and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516:

To a stirred solution of compound 515 in 100 mL dry DCM in a 250 mL two neck RBF, was added NEt3 (37.2 mL, 0.2669 mol) and cooled to 0° C. under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated NaHCO3 solution (1×50 mL). The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H] −232.3 (96.94%).

Synthesis of 517A and 517B:

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated NaHCO3 (1×50 mL) solution, water (1×30 mL) and finally with brine (1×50 mL). Organic phase was dried over $Na_2SO_4$ and solvent was removed in vacuum. Silica gel column chromatographic purification of the crude material was afforded a mixture of diastereomers, which were separated by prep HPLC. Yield:—6 g crude 517A-Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS −[M+H]−266.3, [M+NH4+]−283.5 present, HPLC-97.86%. Stereochemistry confirmed by X-ray.

Synthesis of 518:

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC-98.65%.

General Procedure for the Synthesis of Compound 519: A solution of compound 518 (1 eq) in hexane (15 mL) was added in a drop-wise fashion to an ice-cold solution of LAH in THF (1 M, 2 eq). After complete addition, the mixture was heated at 40° C. over 0.5 h then cooled again on an ice bath. The mixture was carefully hydrolyzed with saturated aqueous $Na_2SO_4$ then filtered through Celite® and reduced to an oil. Column chromatography provided the pure 519 (1.3 g, 68%) which was obtained as a colorless oil. 13C NMR=130.2, 130.1 (×2), 127.9 (×3), 112.3, 79.3, 64.4, 44.7, 38.3, 35.4, 31.5, 29.9 (×2), 29.7, 29.6 (×2), 29.5 (×3), 29.3 (×2), 27.2 (×3), 25.6, 24.5, 23.3, 226, 14.1; Electrospray MS (+ve): Molecular weight for C44H80NO2 (M+H)+Calc. 654.6, Found 654.6.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer™ Nano ZS (Malvern, USA). Particles should be about 20-300 nm, such as 40-100 nm in size. The particle size distribution should be unimodal. The total dsRNA concentration in the formulation, as well as the entrapped fraction, is estimated using a dye exclusion assay. A sample of the formulated dsRNA can be incubated with an RNA-binding dye, such as RiboGreen® (Molecular Probes) in the presence or absence of a formulation disrupting surfactant, e.g., 0.5% Triton™-X100. The total dsRNA in the formulation can be determined by the signal from the sample containing the surfactant, relative to a standard curve. The entrapped fraction is determined by subtracting the "free" dsRNA content (as measured by the signal in the absence of surfactant) from the total dsRNA content. Percent entrapped dsRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

VII. Methods of the Invention

The present invention also provides methods of using an iRNA of the invention and/or a composition of the invention to reduce and/or inhibit GRB10 or GRB14 expression in a cell, such as a cell in a subject, e.g., a hepatocyte. The methods include contacting the cell with an RNAi agent or pharmaceutical composition comprising an iRNA agent of the invention. In some embodiments, the cell is maintained for a time sufficient to obtain degradation of the mRNA transcript of a GRB10 or GRB14 gene.

Reduction in gene expression can be assessed by any methods known in the art. For example, a reduction in the expression of GRB10 or GRB14 may be determined by determining the mRNA expression level of GRB10 or GRB14 using methods routine to one of ordinary skill in the art, e.g., Northern blotting, qRT-PCR; by determining the protein level of GRB10 or GRB14 using methods routine to one of ordinary skill in the art, such as Western blotting, immunological techniques. A reduction in the expression of GRB10 or GRB14 may also be assessed indirectly by measuring a decrease in biological activity of GRB10 or GRB14, e.g., a decrease in the enzymatic activity of GRB10 or GRB14 and/or a change in one or more associated markers of GRB10 or GRB14 activity (e.g., insulin receptor levels, glucose levels, HbA1c levels, etc.).

In the methods of the invention the cell may be contacted in vitro or in vivo, i.e., the cell may be within a subject.

A cell suitable for treatment using the methods of the invention may be any cell that expresses a GRB10 or GRB14 gene. A cell suitable for use in the methods of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell, e.g., a human liver cell.

GRB10 or GRB14 expression is inhibited in the cell by at least about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or about 100%. In preferred embodiments, GRB10 or GRB14 expression is inhibited by at least 20%.

In one embodiment, the in vivo methods of the invention may include administering to a subject a composition containing an iRNA, where the iRNA includes a nucleotide sequence that is complementary to at least a part of an RNA transcript of the GRB10 or GRB14 gene of the mammal to be treated.

When the organism to be treated is a mammal such as a human, the composition can be administered by any means known in the art including, but not limited to oral, intraperitoneal, or parenteral routes, including intracranial (e.g., intraventricular, intraparenchymal and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of GRB10 or GRB14, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the liver.

An iRNA of the invention may be present in a pharmaceutical composition, such as in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

The mode of administration may be chosen based upon whether local or systemic treatment is desired and based upon the area to be treated. The route and site of administration may be chosen to enhance targeting.

In one aspect, the present invention also provides methods for inhibiting the expression of a GRB10 or GRB14 gene in a mammal. The methods include administering to the mammal a composition comprising a dsRNA that targets a GRB10 or GRB14 gene in a cell of the mammal, thereby inhibiting expression of the GRB10 or GRB14 gene in the cell.

In some embodiment, the methods include administering to the mammal a composition comprising a dsRNA that targets a GRB10 or GRB14 gene in a cell of the mammal, thereby inhibiting expression of the GRB10 gene in the cell. In another embodiment, the methods include administering to the mammal a pharmaceutical composition comprising a dsRNA agent that targets a GRB10 or GRB14 gene in a cell of the mammal.

In another aspect, the present invention provides use of an iRNA agent or a pharmaceutical composition of the invention for inhibiting the expression of a GRB10 or GRB14 gene in a mammal.

In yet another aspect, the present invention provides use of an iRNA agent of the invention targeting a GRB10 or GRB14 gene or a pharmaceutical composition comprising such an agent in the manufacture of a medicament for inhibiting expression of a GRB10 or GRB14 gene in a mammal.

Reduction in gene expression can be assessed by any methods known it the art and by methods, e.g. qRT-PCR, described herein. Reduction in protein production can be assessed by any methods known it the art and by methods, e.g. ELISA, enzymatic activity, described herein.

The present invention also provides therapeutic and prophylactic methods which include administering to a subject having, or prone to developing a fatty liver-associated disease, disorder, or condition, the iRNA agents, pharmaceutical compositions comprising an iRNA agent, or vectors comprising an iRNA of the invention.

In one aspect, the present invention provides methods of treating a subject having a disorder that would benefit from reduction in GRB10 or GRB14 expression, e.g., a GRB10- or GRB14-associated disease.

The treatment methods (and uses) of the invention include administering to the subject, e.g., a human, a therapeutically effective amount of a dsRNA agent that inhibits expression of GRB10 or GRB14 or a pharmaceutical composition comprising a dsRNA that inhibits expression of GRB10 or GRB14, thereby treating the subject.

In one aspect, the invention provides methods of preventing at least one symptom in a subject having a disorder that would benefit from reduction in GRB10 or GRB14 expression, e.g., diabetes. The methods include administering to the subject a prophylactically effective amount of dsRNA agent or a pharmaceutical composition comprising a dsRNA, thereby preventing at least one symptom in the subject. In one embodiment, the at least one symptom is a symptom of a GRB10- or GRB14-associated disease.

The present invention also provides use of a therapeutically effective amount of an iRNA agent of the invention or a pharmaceutical composition comprising a dsRNA that inhibits expression of GRB10 or GRB14 for treating a subject, e.g., a subject that would benefit from a reduction and/or inhibition of GRB10 or GRB14 expression, e.g., a GRB10- or GRB14-associated disease, e.g., diabetes.

In another aspect, the present invention provides use of an iRNA agent, e.g., a dsRNA, of the invention targeting a GRB10 or GRB14 for gene or a pharmaceutical composition comprising an iRNA agent targeting a GRB10 or GRB14 for gene in the manufacture of a medicament for treating a subject, e.g., a subject that would benefit from a reduction and/or inhibition of GRB10 or GRB14 for expression, e.g., a GRB10- or GRB14-associated disease.

The present invention also provides use of a prophylactically effective amount of an iRNA agent of the invention or a pharmaceutical composition comprising a dsRNA that inhibits expression of GRB10 or GRB14 for preventing at least one symptom in a subject having a disorder that would benefit from reduction in GRB10 or GRB14 expression, e.g., diabetes.

In another aspect, the present invention provides use of an iRNA agent, e.g., a dsRNA, of the invention targeting a GRB10 or GRB14 gene or a pharmaceutical composition comprising an iRNA agent targeting a GRB10 or GRB14 gene in the manufacture of a medicament for preventing at least one symptom in a subject having a disorder that would benefit from reduction in GRB10 or GRB14 expression, e.g., diabetes.

Accordingly, in one aspect, the present invention provides methods of treating a subject having a disorder that would benefit from reduction in GRB10 or GRB14 expression, e.g., a GRB10- or GRB14-associated disease, such as diabetes. In one embodiment, the GRB10- or GRB14-associated disease is type 2 diabetes. In one embodiment, the GRB10- or GRB14-associated disease is type 1 diabetes. In one embodiment, the GRB10- or GRB14-associated disease is prediabetes. In one embodiment, the GRB10- or GRB14-associated disease is insulin resistance. In one embodiment, the GRB10- or GRB14-associated disease is a diabetes-related condition such as obesity, diabetic neuropathy, diabetic nephropathy, diabetic vasculopathy, diabetic retinopathy, hypertension, dyslipidemia, atherosclerosis, coronary heart disease, stroke, etc.

In another embodiment, the subject is homozygous for the GRB10 gene. Each allele of the gene may encode a functional GRB10 protein. In yet another embodiment, the subject is heterozygous for the GRB10 gene. The subject may have an allele encoding a functional GRB10 protein and an allele encoding a loss of function variant of GRB10. In some embodiments, the subject has a maternally inherited allele encoding a functional GRB10 protein. In some embodiments, the subject has a maternally inherited allele associated with an increased risk of diabetes. In some embodiments, the subject has an allele encoding the GRB10 rs4947710 variant. The allele may be maternally inherited. In some embodiments, the subject has an allele encoding the GRB10 rs2237457 variant. The allele may be maternally inherited. In some embodiments, the subject has an allele encoding the GRB10 rs933360 variant. The allele may be paternally inherited. In some embodiments, the subject has an allele encoding the GRB10 rs6943153 variant. The allele may be maternally inherited. In some embodiments, the subject has a GIGYF1 loss of function allele.

In another embodiment, the subject is homozygous for the GRB14 gene. Each allele of the gene may encode a functional GRB14 protein. In yet another embodiment, the subject is heterozygous for the GRB14 gene. The subject may have an allele encoding a functional GRB14 protein and an allele encoding a loss of function variant of GRB14. In some embodiments, the subject has an allele encoding the rs3923113 variant. In some embodiments, the subject has an allele encoding the rs10195252 variant.

In some embodiments, the subject has a GIGYF1 loss of function allele. In some embodiments, the subject has a GIGYF1 rs221797 variant (e.g., rs221797:A). In some embodiments, the subject has a GIGYF1 rs117231629 variant. In some embodiments, the subject has a GIGYF2 loss of function allele. In some embodiments, the subject has a GIGYF2 rs1801251 variant (e.g., rs1801251:A).

In one embodiment, a GRB10- or GRB14-associated disorder is type 2 diabetes (T2D), used interchangeably with type 2 diabetes mellitus (2DM) or type II diabetes. Type 2 diabetes is a chronic multifactorial polygenic disease, influenced by multiple genes and environmental factors, characterized by impaired glucose intolerance due to insulin resistance or relative insulin deficiency. In the progression of diabetes, insulin secretion is increased, and a large amount of the increase in the first stage of this compensation process is due to increased β-cell mass, which is mainly achieved through an increase in 0-cell number. Eventually, insulin targets such as liver, muscle and adipose tissues become insulin-resistant and pancreatic β-cells show impaired insulin secretion. Progression from normal glucose tolerance to impaired glucose tolerance to type 2 diabetes is characterised by a progressive decline in insulin secretion and plasma insulin concentration and a progressive rise in plasma glucagon concentration. Type 2 diabetic patients are also characterised by hyperglucagonaemia and enhanced hepatic glucose production in response to glucagon as the suppression of glucose production is decreased. Excessive glucose production and lipid accumulation are observed in the livers of obese patients with insulin resistance. Excessive hepatic glucose production drives hyperglycemia. Symptoms and signs of type 2 diabetes include increased thirst, frequent urination, increased hunger, fatigue, blurred vision, slow-healing sores, frequent infections, and areas of darkened skin. Uncontrolled type 2 diabetes leads to serious complications including diabetic retinopathy, diabetic vasculopathy, diabetic neuropathy, and diabetic nephropathy. Being overweight or obese is a major modifiable risk factor for type 2 diabetes, and other risk factors include physical inactivity and family history. Early stage type 2 diabetes may be controlled by dietary regimen and weight loss. In advanced stages, type 2 diabetes can be treated by medication (e.g., metformin, sulfonylureas, meglitinides) or insulin injection.

In one embodiment, a GRB10- or GRB14-associated disorder is type 1 diabetes (T1D), also known as juvenile diabetes. Type 1 diabetes is a polygenic disease that is highly heritable and is characterized by no production or insufficient production of insulin by the pancreas. While the cause of type 1 diabetes is unknown, the pathophysiology involves an autoimmune destruction of the insulin-producing 0-cells in the pancreas. The classic symptoms are frequent urination, increased thirst, increased hunger, and weight loss, and may include blurry vision, tiredness, and poor wound healing. Symptoms typically develop over a short period of time. Uncontrolled type 1 diabetes can lead to complications including ketoacidosis, cardiovascular disease, diabetic neuropathy, diabetic retinopathy, sexual dysfunction, and a high prevalence of urinary tract infections. Insulin injections are generally necessary for the control of type 1 diabetes.

In one embodiment, a GRB10- or GRB14associated disorder is prediabetes. Prediabetes may be characterized by elevated blood glucose levels that are below the threshold for type 2 diabetes, but may be an early stage of disease that progresses to type 2 diabetes. Subjects having prediabetes often have obesity (especially abdominal or visceral obesity), dyslipidemia with high triglycerides and/or low HDL cholesterol, and hypertension. Subjects with prediabetes may be at increased risk of cardiovascular disease and/or of developing type 2 diabetes.

In one embodiment, a GRB10- or GRB14-associated disorder is insulin resistance. Insulin resistance is not entirely understood, but is characterized by reduced sensitivity of of insulin-targeting tissues to insulin resulting in the inability of insulin to properly regulate glucose transport and blood glucose levels. Insulin resistance is a component of type 2 diabetes and may be a component of prediabetes. Risk factors for insulin resistance include obesity, a sedentary lifestyle, and hereditary factors. Insulin resistance can generally be improved with lifestyle modifications, including diet and exercise.

In one embodiment, an "iRNA" for use in the methods of the invention is a "dual targeting RNAi agent." The term "dual targeting RNAi agent" refers to a molecule comprising a first dsRNA agent comprising a complex of ribonucleic acid molecules, having a duplex structure comprising two anti-parallel and substantially complementary nucleic acid strands, referred to as having "sense" and "antisense" orientations with respect to a first target RNA, i.e., a GRB10 or GRB14 gene, covalently attached to a molecule comprising a second dsRNA agent comprising a complex of ribonucleic acid molecules, having a duplex structure comprising two anti-parallel and substantially complementary nucleic acid strands, referred to as having "sense" and "antisense" orientations with respect to a second target RNA. In some embodiments of the invention, a dual targeting RNAi agent triggers the degradation of the first and the second target RNAs, e.g., mRNAs, through a post-transcriptional gene-silencing mechanism referred to herein as RNA interference or RNAi.

The dsRNA agent may be administered to the subject at a dose of about 0.1 mg/kg to about 50 mg/kg. Typically, a suitable dose will be in the range of about 0.1 mg/kg to about 5.0 mg/kg, preferably about 0.3 mg/kg and about 3.0 mg/kg.

The iRNA can be administered by intravenous infusion over a period of time, on a regular basis. In certain embodiments, after an initial treatment regimen, the treatments can be administered on a less frequent basis.

Administration of the iRNA can reduce GRB10 or GRB14 levels, e.g., in a cell, tissue, blood, urine or other compartment of the patient by at least about 5%, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 39, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or at least about 99% or more. In a preferred embodiment, administration of the iRNA can reduce GRB10 or GRB14 levels, e.g., in a cell, tissue, blood, urine or other compartment of the patient by at least 20%.

Before administration of a full dose of the iRNA, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the iRNA can be administered subcutaneously, i.e., by subcutaneous injection. One or more injections may be used to deliver the desired daily dose of iRNA to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of iRNA on a regular basis, such as every other day or to once a year. In certain embodiments, the iRNA is administered about once per week, once every 7-10 days, once every 2 weeks, once every 3 weeks, once every 4 weeks, once every 5 weeks, once every 6 weeks, once every 7 weeks, once every 8 weeks, once every 9 weeks, once every 10 weeks, once every 11 weeks, once every 12 weeks, once per month, once every 2 months, once every 3 months once per quarter), once every 4 months, once every 5 months, or once every 6 months.

In one embodiment, the method includes administering a composition featured herein such that expression of the target GRB10 or GRB14 gene is decreased, such as for about 1, 2, 3, 4, 5, 6, 7, 8, 12, 16, 18, 24 hours, 28, 32, or about 36 hours. In one embodiment, expression of the target GRB10 or GRB14 gene is decreased for an extended duration, e.g., at least about two, three, four days or more, e.g., about one week, two weeks, three weeks, or four weeks or longer.

Preferably, the iRNAs useful for the methods and compositions featured herein specifically target RNAs (primary or processed) of the target GRB10 or GRB14 gene. Compositions and methods for inhibiting the expression of these genes using iRNAs can be prepared and performed as described herein.

Administration of the dsRNA according to the methods of the invention may result in a reduction of the severity, signs, symptoms, and/or markers of such diseases or disorders in a patient with a disorder of lipid metabolism. By "reduction" in this context is meant a statistically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of diabetes may be assessed, for example, by periodic monitoring of glucose levels or HbA1c levels. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA or pharmaceutical composition thereof, "effective against" a disorder indicates that administration in a clinically appropriate manner results in a beneficial effect for at least a statistically significant fraction of patients having the disorder, such as an improvement of symptoms, a cure, a reduction in disease, extension of life, improvement in quality of life, or other effect generally recognized as positive by medical doctors familiar with treating the disorder (e.g., diabetes) and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art.

The iRNA agent and an additional therapeutic agent and/or treatment may be administered at the same time and/or in the same combination, e.g., subcutaneously, or the additional therapeutic agent can be administered as part of a separate composition or at separate times and/or by another method known in the art or described herein.

VIII. Kits

The present invention also provides kits for performing any of the methods of the invention. Such kits include one or more RNAi agent(s) and instructions for use, e.g., instructions for inhibiting expression of a GRB10 or GRB14 in a cell by contacting the cell with an RNAi agent or pharmaceutical composition of the invention in an amount effective to inhibit expression of the GRB10 or GRB14. The kits may optionally further comprise means for contacting the cell with the RNAi agent (e.g., an injection device), or means for measuring the inhibition of GRB10 or GRB14 (e.g., means for measuring the inhibition of GRB10 or GRB14 mRNA and/or GRB10 or GRB14 protein). Such means for measuring the inhibition of GRB10 or GRB14 may comprise a means for obtaining a sample from a subject, such as, e.g., a plasma sample. The kits of the invention may optionally further comprise means for administering the RNAi agent(s) to a subject or means for determining the therapeutically effective or prophylactically effective amount.

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1. GRB10/GRB14 iRNA Design, Synthesis, and Selection

Nucleic acid sequences provided herein are represented using standard nomenclature. See the abbreviations of Table 2.

TABLE 2

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine -3'-phosphorothioate |
| Us | uridine -3'-phosphorothioate |
| N | any nucleotide (G, A, C, T or U) |
| a | 2'-O-methyladenosine-3'-phosphate |
| as | 2'-O-methyladenosine-3'- phosphorothioate |
| c | 2'-O-methylcytidine-3'-phosphate |
| cs | 2'-O-methylcytidine-3'- phosphorothioate |
| g | 2'-O-methylguanosine-3'-phosphate |
| gs | 2'-O-methylguanosine-3'- phosphorothioate |
| t | 2'-O-methyl-5-methyluridine-3'-phosphate |

TABLE 2-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol |
| P | Phosphate |
| VP | Vinyl-phosphate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine-3'-phosphate |
| dTs | 2'-deoxythymidine-3'-phosphorothioate |
| dU | 2'-deoxyuridine |
| dUs | 2'-deoxyuridine-3'-phosphorothioate |
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| (Aam) | 2'-O-(N-methylacetamide)adenosine-3'-phosphate |
| (Aams) | 2'-O-(N-methylacetamide)adenosine-3'-phosphorothioate |
| (Gam) | 2'-O-(N-methylacetamide)guanosine-3'-phosphate |
| (Gams) | 2'-O-(N-methylacetamide)guanosine-3'-phosphorothioate |
| (Tam) | 2'-O-(N-methylacetamide)thymidine-3'-phosphate |
| (Tams) | 2'-O-(N-methylacetamide)thymidine-3'-phosphorothioate |
| (Aeo) | 2'-O-methoxyethyladenosine-3'-phosphate |
| (Aeos) | 2'-O-methoxyethyladenosine-3'-phosphorothioate |
| (Geo) | 2'-O-methoxyethylguanosine-3'-phosphate |
| (Geos) | 2'-O-methoxyethylguanosine-3'-phosphorothioate |
| (Teo) | 2'-O-methoxyethyl-5-methyluridine-3'-phosphate |
| (Teos) | 2'-O-methoxyethyl-5-methyluridine-3'-phosphorothioate |
| (m5Ceo) | 2'-O-methoxyethyl-5-methylcytidine-3'-phosphate |
| (m5Ceos) | 2'-O-methoxyethyl-5-methylcytidine-3'-phosphorothioate |
| (A3m) | 3'-O-methyladenosine-2'-phosphate |
| (A3mx) | 3'-O-methyl-xylofuranosyladenosine-2'-phosphate |
| (G3m) | 3'-O-methylguanosine-2'-phosphate |
| (G3mx) | 3'-O-methyl-xylofuranosylguanosine-2'-phosphate |
| (C3m) | 3'-O-methylcytidine-2'-phosphate |
| (C3mx) | 3'-O-methyl-xylofuranosylcytidine-2'-phosphate |
| (U3m) | 3'-O-methyluridine-2'-phosphate |
| U3mx) | 3'-O-methyl-xylofuranosyluridine-2'-phosphate |
| (m5Cam) | 2'-O-(N-methylacetamide)-5-methylcytidine-3'-phosphate |
| (m5Cams) | 2'-O-(N-methylacetamide)-5-methylcytidine-3'-phosphorothioate |
| (Chd) | 2'-O-hexadecyl-cytidine-3'-phosphate |
| (Chds) | 2'-O-hexadecyl-cytidine-3'-phosphorothioate |
| (Uhd) | 2'-O-hexadecyl-uridine-3'-phosphate |
| (Uhds) | 2'-O-hexadecyl-uridine-3'-phosphorothioate |
| (pshe) | Hydroxyethylphosphorothioate |

[1]The chemical structure of L96 is as follows:

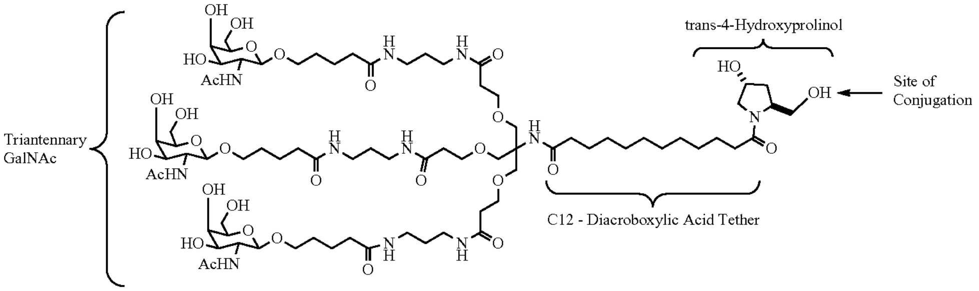

Experimental Methods

This Example describes methods for the design, synthesis, and selection of GRB10 10 and GRB14 iRNA agents.

Bioinformatics

Source of Reagents

Where the source of a reagent is not specifically given herein, such reagent can be obtained from any supplier of reagents for molecular biology at a quality/purity standard for application in molecular biology.

Transcripts A set of siRNAs targeting the human growth factor receptor bound protein 10 (GRB10) gene (human NCBI refseqID NM_001350814.2; NCBI GeneID: 2887) and the human growth factor receptor bound protein 14 (GRB14) gene (human NCBI refseqID NM_004490.3; NCBI GeneID: 2888) were designed using custom R and Python scripts. All the GRB10 siRNA designs have a perfect match to the human GRB10 transcript (transcript variant 1). The human NM_001350814 REFSEQ mRNA, version 2, has a length of 5,468 bases. All the GRB14 siRNA designs have a perfect match to the human GRB14 transcript (transcript variant 1). The human NM_004490 REFSEQ mRNA, version 3, has a length of 2,415 bases.

siRNA Synthesis siRNAs were synthesized and annealed using routine methods known in the art.

Briefly, siRNA sequences were synthesized at 1 μmol scale on a Mermade 192 synthesizer (BioAutomation) using the solid support mediated phosphoramidite chemistry. The solid support was controlled pore glass (500 A) loaded with custom GalNAc ligand or universal solid support (AM biochemical). Ancillary synthesis reagents, 2'-F and 2'-O-Methyl RNA and deoxy phosphoramidites were obtained from Thermo-Fisher (Milwaukee, WI) and Hongene (China). 2'F 2'-O-Methyl, GNA (glycol nucleic acids), 5'phosphate and other modifications were introduced using the corresponding phosphoramidites. Synthesis of 3' GalNAc conjugated single strands was performed on a GalNAc modified CPG support. Custom CPG universal solid support was used for the synthesis of antisense single strands. Coupling time for all phosphoramidites (100 mM in acetonitrile) was 5 min employing 5-Ethylthio-1H-tetrazole (ETT) as activator (0.6 M in acetonitrile). Phosphorothioate linkages were generated using a 50 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (1:1 v/v). Oxidation time was 3 minutes. All sequences were synthesized with final removal of the DMT group ("DMT off").

Upon completion of the solid phase synthesis, oligoribonucleotides were cleaved from the solid support and deprotected in sealed 96 deep well plates using 200 μL Aqueous Methylamine reagents at 60° C. for 20 minutes. For sequences containing 2' ribo residues (2'-OH) that are protected with a tert-butyl dimethyl silyl (TBDMS) group, a second step deprotection was performed using TEA.3HF (triethylamine trihydro fluoride) reagent. To the methylamine deprotection solution, 200 uL of dimethyl sulfoxide (DMSO) and 300 ul TEA.3HF reagent was added and the solution was incubated for additional 20 min at 60° C. At the end of cleavage and deprotection step, the synthesis plate was allowed to come to room temperature and was precipitated by addition of 1 mL of acetontile: ethanol mixture (9:1). The plates were cooled at −80 C for 2 hrs, supernatant decanted carefully with the aid of a multi-channel pipette. The oligonucleotide pellet was re-suspended in 20 mM NaOAc buffer and were desalted using a 5 mL HiTrap size exclusion column (GE Healthcare) on an AKTA Purifier System equipped with an A905 autosampler and a Frac 950 fraction collector. Desalted samples were collected in 96-well plates. Samples from each sequence were analyzed by LC-MS to confirm the identity, UV (260 nm) for quantification and a selected set of samples by IEX chromatography to determine purity.

Annealing of single strands was performed on a Tecan liquid handling robot. Equimolar mixture of sense and antisense single strands were combined and annealed in 96 well plates. After combining the complementary single strands, the 96-well plate was sealed tightly and heated in an oven at 100° C. for 10 minutes and allowed to come slowly to room temperature over a period 2-3 hours. The concentration of each duplex was normalized to 10 μM in 1×PBS and then submitted for in vitro screening assays.

Detailed lists of the unmodified nucleotide sequences of the sense strand and antisense strand sequences for dsRNA agents targeting GRB10 are shown in Tables 3 and 4. The agents listed in Table 3 identify duplexes conjugated to a GalNAc ligand. The agents listed in Table 4 identify duplexes conjugated to a C16 ligand.

Detailed lists of the modified nucleotide sequences of the sense strand and antisense strand sequences for dsRNA agents targeting GRB10 is shown in Tables 5 and 6. The agents listed in Table 5 identify duplexes conjugated to a GalNAc ligand. The agents listed in Table 6 identify duplexes conjugated to a C16 ligand.

Detailed lists of the unmodified nucleotide sequences of the sense strand and antisense strand sequences for dsRNA agents targeting GRB14 are shown in Tables 7 and 8.

Detailed lists of the modified nucleotide sequences of the sense strand and antisense strand sequences for dsRNA agents targeting GRB14 are shown in Tables 9 and 10.

TABLE 3

Human Unmodified Sense and Antisense Strand Sequences of GRB10 dsRNA Agents that use GalNAc Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1302784 | CAAGGUGGAGCAGACACCUCU | 53 | 853-873 | AGAGGUGUCUGCUCCACCUUGUC | 188 | 851-873 |
| AD-1302785 | GAGCAGACACCUCGCAGUCAU | 54 | 860-880 | AUGACUGCGAGGUGUCUGCUCCA | 189 | 858-880 |
| AD-1302786 | CACCUCGCAGUCAACAAGACU | 55 | 867-887 | AGUCUUGUUGACUGCGAGGUGUC | 190 | 865-887 |
| AD-1302787 | CAGUCAACAAGACCCGGCAGU | 56 | 874-894 | ACUGCCGGGUCUUGUUGACUGCG | 191 | 872-894 |

TABLE 3-continued

Human Unmodified Sense and Antisense Strand Sequences of GRB10 dsRNA Agents that use GalNAc Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1302788 | CAAGACCCGGCAGGACCAGGU | 57 | 881-901 | ACCUGGUCCUGCCGGGUCUUGUU | 192 | 879-901 |
| AD-1302789 | CGCACAGUCUGACCGACUUGU | 58 | 907-927 | ACAAGUCGGUCAGACUGUGCGGG | 193 | 905-927 |
| AD-1302790 | UCUGACCGACUUGCGAAUCAU | 59 | 914-934 | AUGAUUCGCAAGUCGGUCAGACU | 194 | 912-934 |
| AD-1302791 | GAUGAUGUGGACCUGGAAGCU | 60 | 941-961 | AGCUUCCAGGUCCACAUCAUCCU | 195 | 939-961 |
| AD-1302792 | UGGACCUGGAAGCCCUGGUGU | 61 | 948-968 | ACACCAGGGCUUCCAGGUCCACA | 196 | 946-968 |
| AD-1302793 | GGAAGCCCUGGUGAACGAUAU | 62 | 955-975 | AUAUCGUUCACCAGGGCUUCCAG | 197 | 953-975 |
| AD-1302794 | CUGGUGAACGAUAUGAAUGCU | 63 | 962-982 | AGCAUUCAUAUCGUUCACCAGGG | 198 | 960-982 |
| AD-1302795 | ACGAUAUGAAUGCAUCCCUGU | 64 | 969-989 | ACAGGGAUGCAUUCAUAUCGUUC | 199 | 967-989 |
| AD-1302796 | GAAUGCAUCCCUGGAGAGCCU | 65 | 976-996 | AGGCUCUCCAGGGAUGCAUUCAU | 200 | 974-996 |
| AD-1302797 | UCCCUGGAGAGCCUGUACUCU | 66 | 983-1003 | AGAGUACAGGCUCUCCAGGGAUG | 201 | 981-1003 |
| AD-1302798 | GAGCCUGUACUCGGCCUGCAU | 67 | 991-1011 | AUGCAGGCCGAGUACAGGCUCUC | 202 | 989-1011 |
| AD-1302799 | UACUCGGCCUGCAGCAUGCAU | 68 | 998-1018 | AUGCAUGCUGCAGGCCGAGUACA | 203 | 996-1018 |
| AD-1302800 | CCUGCAGCAUGCAGUCAGACU | 69 | 1005-1025 | AGUCUGACUGCAUGCUGCAGGCC | 204 | 1003-1025 |
| AD-1302801 | CAUGCAGUCAGACACGGUGCU | 70 | 1012-1032 | AGCACCGUGUCUGACUGCAUGCU | 205 | 1010-1032 |
| AD-1302802 | CUCCUGCAGAAUGGCCAGCAU | 71 | 1034-1054 | AUGCUGGCCAUUCUGCAGGAGGG | 206 | 1032-1054 |
| AD-1302803 | GAAUGGCCAGCAUGCCCGCAU | 72 | 1042-1062 | AUGCGGGCAUGCUGGCCAUUCUG | 207 | 1040-1062 |
| AD-1302804 | UCAGGCCCUCCUCGGUCCAUU | 73 | 1076-1096 | AAUGGACCGAGGAGGGCCUGAAG | 208 | 1074-1096 |
| AD-1302805 | CCUCGGUCCAUCCAGCCACAU | 74 | 1085-1105 | AUGUGGCUGGAUGGACCGAGGAG | 209 | 1083-1105 |
| AD-1302806 | CCAUCCAGCCACAGGUGUCCU | 75 | 1092-1112 | AGGACACCUGUGGCUGGAUGGAC | 210 | 1090-1112 |
| AD-1302807 | CGCUCCCAGCCUGUGCACAUU | 76 | 1130-1150 | AAUGUGCACAGGCUGGGAGCGCU | 211 | 1128-1150 |
| AD-1302808 | AGCCUGUGCACAUCCUCGCUU | 77 | 1137-1157 | AAGCGAGGAUGUGCACAGGCUGG | 212 | 1135-1157 |
| AD-1302809 | GCCUUCAGGAGGAAGACCAGU | 78 | 1164-1184 | ACUGGUCUUCCUCCUGAAGGCGC | 213 | 1162-1184 |
| AD-1302810 | GGAGGAAGACCAGCAGUUUAU | 79 | 1171-1191 | AUAAACUGCUGGUCUUCCUCCUG | 214 | 1169-1191 |

TABLE 3-continued

Human Unmodified Sense and Antisense Strand Sequences of GRB10 dsRNA Agents that use GalNAc Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1302811 | GACCAGCAGUUUAGAACCUCU | 80 | 1178-1198 | AGAGGUUCUAAACUGCUGGUCUU | 215 | 1176-1198 |
| AD-1302812 | AGUUUAGAACCUCAUCUCUGU | 81 | 1185-1205 | ACAGAGAUGAGGUUCUAAACUGC | 216 | 1183-1205 |
| AD-1302813 | AACCUCAUCUCUGCCGGCCAU | 82 | 1192-1212 | AUGGCCGGCAGAGAUGAGGUUCU | 217 | 1190-1212 |
| AD-1302814 | CAAUCCUUUUCCUGAACUCUU | 83 | 1216-1236 | AAGAGUUCAGGAAAAGGAUUGGG | 218 | 1214-1236 |
| AD-1302815 | UUUCCUGAACUCUGUGGCCCU | 84 | 1223-1243 | AGGGCCACAGAGUUCAGGAAAAG | 219 | 1221-1243 |
| AD-1302816 | AACUCUGUGGCCCUGGGAGCU | 85 | 1230-1250 | AGCUCCCAGGGCCACAGAGUUCA | 220 | 1228-1250 |
| AD-1302817 | UGUGCUCACGCCGGGUUCUUU | 86 | 1255-1275 | AAAGAACCCGGCGUGAGCACAGG | 221 | 1253-1275 |
| AD-1302818 | ACGCCGGGUUCUUUACCUCCU | 87 | 1262-1282 | AGGAGGUAAAGAACCCGGCGUGA | 222 | 1260-1282 |
| AD-1302819 | GUUCUUUACCUCCGAGCCAGU | 88 | 1269-1289 | ACUGGCUCGGAGGUAAAGAACCC | 223 | 1267-1289 |
| AD-1302820 | UGUUAAAGUCUUUAGUGAAGU | 89 | 1306-1326 | ACUUCACUAAAGACUUUAACAUC | 224 | 1304-1326 |
| AD-1302821 | GUCUUUAGUGAAGAUGGGACU | 90 | 1313-1333 | AGUCCCAUCUUCACUAAAGACUU | 225 | 1311-1333 |
| AD-1302822 | GUGAAGAUGGGACAAGCAAAU | 91 | 1320-1340 | AUUUGCUUGUCCCAUCUUCACUA | 226 | 1318-1340 |
| AD-1302823 | UGGGACAAGCAAAGUGGUGGU | 92 | 1327-1347 | ACCACCACUUUGCUUGUCCCAUC | 227 | 1325-1347 |
| AD-1302824 | AGCAAAGUGGUGGAGAUUCUU | 93 | 1334-1354 | AAGAAUCUCCACCACUUUGCUUG | 228 | 1332-1354 |
| AD-1302825 | UGGUGGAGAUUCUAGCAGACU | 94 | 1341-1361 | AGUCUGCUAGAAUCUCCACCACU | 229 | 1339-1361 |
| AD-1302826 | GAUUCUAGCAGACAUGACAGU | 95 | 1348-1368 | ACUGUCAUGUCUGCUAGAAUCUC | 230 | 1346-1368 |
| AD-1302827 | GCAGACAUGACAGCCAGAGAU | 96 | 1355-1375 | AUCUCUGGCUGUCAUGUCUGCUA | 231 | 1353-1375 |
| AD-1302828 | UGACAGCCAGAGACCUGUGCU | 97 | 1362-1382 | AGCACAGGUCUCUGGCUGUCAUG | 232 | 1360-1382 |
| AD-1302829 | CAGAGACCUGUGCCAAUUGCU | 98 | 1369-1389 | AGCAAUUGGCACAGGUCUCUGGC | 233 | 1367-1389 |
| AD-1302830 | CUGUGCCAAUUGCUGGUUUAU | 99 | 1376-1396 | AUAAACCAGCAAUUGGCACAGGU | 234 | 1374-1396 |
| AD-1302831 | AAUUGCUGGUUUACAAAAGUU | 100 | 1383-1403 | AACUUUUGUAAACCAGCAAUUGG | 235 | 1381-1403 |
| AD-1302832 | GGUUUACAAAAGUCACUGUGU | 101 | 1390-1410 | ACACAGUGACUUUUGUAAACCAG | 236 | 1388-1410 |
| AD-1302833 | AAAAGUCACUGUGUGGAUGAU | 102 | 1397-1417 | AUCAUCCACACAGUGACUUUUGU | 237 | 1395-1417 |
| AD-1302834 | ACUGUGUGGAUGACAACAGCU | 103 | 1404-1424 | AGCUGUUGUCAUCCACACAGUGA | 238 | 1402-1424 |
| AD-1302835 | GGAUGACAACAGCUGGACACU | 104 | 1411-1431 | AGUGUCCAGCUGUUGUCAUCCAC | 239 | 1409-1431 |

TABLE 3-continued

Human Unmodified Sense and Antisense Strand Sequences of GRB10 dsRNA Agents that use GalNAc Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1302836 | AACAGCUGGACACUAGUGGAU | 105 | 1418-1438 | AUCCACUAGUGUCCAGCUGUUGU | 240 | 1416-1438 |
| AD-1302837 | GGACACUAGUGGAGCACCACU | 106 | 1425-1445 | AGUGGUGCUCCACUAGUGUCCAG | 241 | 1423-1445 |
| AD-1302838 | GUGGAGCACCACCCGCACCUU | 107 | 1433-1453 | AAGGUGCGGGUGGUGCUCCACUA | 242 | 1431-1453 |
| AD-1302839 | ACCACCCGCACCUAGGAUUAU | 108 | 1440-1460 | AUAAUCCUAGGUGCGGGUGGUGC | 243 | 1438-1460 |
| AD-1302840 | AGGUGCUUGGAAGACCAUGAU | 109 | 1463-1483 | AUCAUGGUCUUCCAAGCACCUCU | 244 | 1461-1483 |
| AD-1302841 | UGGAAGACCAUGAGCUGGUGU | 110 | 1470-1490 | ACACCAGCUCAUGGUCUUCCAAG | 245 | 1468-1490 |
| AD-1302842 | CCAUGAGCUGGUGGUCCAGGU | 111 | 1477-1497 | ACCUGGACCACCAGCUCAUGGUC | 246 | 1475-1497 |
| AD-1302843 | CUGGUGGUCCAGGUGGAGAGU | 112 | 1484-1504 | ACUCUCCACCUGGACCACCAGCU | 247 | 1482-1504 |
| AD-1302844 | UCCAGGUGGAGAGUACCAUGU | 113 | 1491-1511 | ACAUGGUACUCUCCACCUGGACC | 248 | 1489-1511 |
| AD-1302845 | GGAGAGUACCAUGGCCAGUGU | 114 | 1498-1518 | ACACUGGCCAUGGUACUCUCCAC | 249 | 1496-1518 |
| AD-1302846 | ACCAUGGCCAGUGAGAGUAAU | 115 | 1505-1525 | AUUACUCUCACUGGCCAUGGUAC | 250 | 1503-1525 |
| AD-1302847 | CCAGUGAGAGUAAAUUUCUAU | 116 | 1512-1532 | AUAGAAAUUUACUCUCACUGGCC | 251 | 1510-1532 |
| AD-1302848 | GAGUAAAUUUCUAUUCAGGAU | 117 | 1519-1539 | AUCCUGAAUAGAAAUUUACUCUC | 252 | 1517-1539 |
| AD-1302849 | UUCUAUUCAGGAAGAAUUACU | 118 | 1527-1547 | AGUAAUUCUUCCUGAAUAGAAAU | 253 | 1525-1547 |
| AD-1302850 | CAGGAAGAAUUACGCAAAAUU | 119 | 1534-1554 | AAUUUUGCGUAAUUCUUCCUGAA | 254 | 1532-1554 |
| AD-1302851 | AAUUACGCAAAAUACGAGUUU | 120 | 1541-1561 | AAACUCGUAUUUUGCGUAAUUCU | 255 | 1539-1561 |
| AD-1302852 | CAAAAUACGAGUUCUUUAAAU | 121 | 1548-1568 | AUUUAAAGAACUCGUAUUUUGCG | 256 | 1546-1568 |
| AD-1302853 | UUUCUUCCCAGAACAGAUGGU | 122 | 1579-1599 | ACCAUCUGUUCUGGGAAGAAAUU | 257 | 1577-1599 |
| AD-1302854 | CCAGAACAGAUGGUUACUUGU | 123 | 1586-1606 | ACAAGUAACCAUCUGUUCUGGGA | 258 | 1584-1606 |
| AD-1302855 | AGAUGGUUACUUGGUGCCAGU | 124 | 1593-1613 | ACUGGCACCAAGUAACCAUCUGU | 259 | 1591-1613 |
| AD-1302856 | UACUUGGUGCCAGCAGUCAAU | 125 | 1600-1620 | AUUGACUGCUGGCACCAAGUAAC | 260 | 1598-1620 |
| AD-1302857 | UGCCAGCAGUCAAAUGGCAGU | 126 | 1607-1627 | ACUGCCAUUUGACUGCUGGCACC | 261 | 1605-1627 |
| AD-1302858 | AGUCAAAUGGCAGUCAAACCU | 127 | 1614-1634 | AGGUUUGACUGCCAUUUGACUGC | 262 | 1612-1634 |

TABLE 3-continued

Human Unmodified Sense and Antisense Strand Sequences of GRB10 dsRNA Agents that use GalNAc Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1302859 | UGGCAGUCAAACCCAGCUUUU | 128 | 1621-1641 | AAAAGCUGGGUUUGACUGCCAUU | 263 | 1619-1641 |
| AD-1302860 | UUUUCUGAACUCCAGUAGUUU | 129 | 1648-1668 | AAACUACUGGAGUUCAGAAAAUU | 264 | 1646-1668 |
| AD-1302861 | AACUCCAGUAGUUGUCCUGAU | 130 | 1655-1675 | AUCAGGACAACUACUGGAGUUCA | 265 | 1653-1675 |
| AD-1302862 | GUAGUUGUCCUGAAAUUCAAU | 131 | 1662-1682 | AUUGAAUUUCAGGACAACUACUG | 266 | 1660-1682 |
| AD-1302863 | UUGCAUGUGAAAGAGCUGGGU | 132 | 1688-1708 | ACCCAGCUCUUUCACAUGCAAAA | 267 | 1686-1708 |
| AD-1302864 | UGAAAGAGCUGGGAAAGAAAU | 133 | 1695-1715 | AUUUCUUUCCCAGCUCUUUCACA | 268 | 1693-1715 |
| AD-1302865 | GCUGGGAAAGAAAUCAUGGAU | 134 | 1702-1722 | AUCCAUGAUUUCUUUCCCAGCUC | 269 | 1700-1722 |
| AD-1302866 | AAGCUGUAUGUGUGUUUGCGU | 135 | 1724-1744 | ACGCAAACACACAUACAGCUUUU | 270 | 1722-1744 |
| AD-1302867 | AUGUGUGUUUGCGGAGAUCUU | 136 | 1731-1751 | AAGAUCUCCGCAAACACACAUAC | 271 | 1729-1751 |
| AD-1302868 | UUUGCGGAGAUCUGGCCUUUU | 137 | 1738-1758 | AAAAGGCCAGAUCUCCGCAAACA | 272 | 1736-1758 |
| AD-1302869 | AGAUCUGGCCUUUAUUGCUCU | 138 | 1745-1765 | AGAGCAAUAAAGGCCAGAUCUCC | 273 | 1743-1765 |
| AD-1302870 | GCCUUUAUUGCUCCACCAAGU | 139 | 1752-1772 | ACUUGGUGGAGCAAUAAAGGCCA | 274 | 1750-1772 |
| AD-1302871 | UUGCUCCACCAAGGGAACUUU | 140 | 1759-1779 | AAAGUUCCCUUGGUGGAGCAAUA | 275 | 1757-1779 |
| AD-1302872 | ACCCAGACACCUGCAGCUGCU | 141 | 1786-1806 | AGCAGCUGCAGGUGUCUGGGUUC | 276 | 1784-1806 |
| AD-1302873 | GCCGACCUGGAGGACAGCAAU | 142 | 1808-1828 | AUUGCUGUCCUCCAGGUCGGCCA | 277 | 1806-1828 |
| AD-1302874 | UGGAGGACAGCAACAUCUUCU | 143 | 1815-1835 | AGAAGAUGUUGCUGUCCUCCAGG | 278 | 1813-1835 |
| AD-1302875 | CAGCAACAUCUUCUCCCUGAU | 144 | 1822-1842 | AUCAGGGAGAAGAUGUUGCUGUC | 279 | 1820-1842 |
| AD-1302876 | AUCUUCUCCCUGAUCGCUGGU | 145 | 1829-1849 | ACCAGCGAUCAGGGAGAAGAUGU | 280 | 1827-1849 |
| AD-1302877 | CCCUGAUCGCUGGCAGGAAGU | 146 | 1836-1856 | ACUUCCUGCCAGCGAUCAGGGAG | 281 | 1834-1856 |
| AD-1302878 | CGCUGGCAGGAAGCAGUACAU | 147 | 1843-1863 | AUGUACUGCUUCCUGCCAGCGAU | 282 | 1841-1863 |
| AD-1302879 | UACAGACCACGGGCUCUGCAU | 148 | 1870-1890 | AUGCAGAGCCCGUGGUCUGUAGG | 283 | 1868-1890 |
| AD-1302880 | AAACAAAGUCAGGAAUGAAAU | 149 | 1897-1917 | AUUUCAUUCCUGACUUUGUUUGG | 284 | 1895-1917 |
| AD-1302881 | GUCAGGAAUGAAACUAAAGAU | 150 | 1904-1924 | AUCUUUAGUUUCAUUCCUGACUU | 285 | 1902-1924 |
| AD-1302882 | AUGAAACUAAAGAGCUGAGGU | 151 | 1911-1931 | ACCUCAGCUCUUUAGUUUCAUUC | 286 | 1909-1931 |
| AD-1302883 | UAAAGAGCUGAGGUUGCUCUU | 152 | 1918-1938 | AAGAGCAACCUCAGCUCUUUAGU | 287 | 1916-1938 |

TABLE 3-continued

Human Unmodified Sense and Antisense Strand Sequences of GRB10 dsRNA Agents that use GalNAc Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1302884 | CUGAGGUUGCUCUGUGCAGAU | 153 | 1925-1945 | AUCUGCACAGAGCAACCUCAGCU | 288 | 1923-1945 |
| AD-1302885 | UGCUCUGUGCAGAGGACGAGU | 154 | 1932-1952 | ACUCGUCCUCUGCACAGAGCAAC | 289 | 1930-1952 |
| AD-1302886 | UGCAGAGGACGAGCAAACCAU | 155 | 1939-1959 | AUGGUUUGCUCGUCCUCUGCACA | 290 | 1937-1959 |
| AD-1302887 | GACGAGCAAACCAGGACGUGU | 156 | 1946-1966 | ACACGUCCUGGUUUGCUCGUCCU | 291 | 1944-1966 |
| AD-1302888 | AAACCAGGACGUGCUGGAUGU | 157 | 1953-1973 | ACAUCCAGCACGUCCUGGUUUGC | 292 | 1951-1973 |
| AD-1302889 | GACGUGCUGGAUGACAGCGUU | 158 | 1960-1980 | AACGCUGUCAUCCAGCACGUCCU | 293 | 1958-1980 |
| LAD-1302890 | UGGAUGACAGCGUUCAGACUU | 159 | 1967-1987 | AAGUCUGAACGCUGUCAUCCAGC | 294 | 1965-1987 |
| AD-1302891 | UGGAAUGCUCCUUUACCAGAU | 160 | 1996-2016 | AUCUGGUAAAGGAGCAUUCCAUA | 295 | 1994-2016 |
| AD-1302892 | CUCCUUUACCAGAAUUACCGU | 161 | 2003-2023 | ACGGUAAUUCUGGUAAAGGAGCA | 296 | 2001-2023 |
| AD-1302893 | ACCAGAAUUACCGAAUCCCUU | 162 | 2010-2030 | AAGGGAUUCGGUAAUUCUGGUAA | 297 | 2008-2030 |
| AD-1302894 | UUACCGAAUCCCUCAGCAGAU | 163 | 2017-2037 | AUCUGCUGAGGGAUUCGGUAAUU | 298 | 2015-2037 |
| AD-1302895 | AUCCCUCAGCAGAGGAAGGCU | 164 | 2024-2044 | AGCCUUCCUCUGCUGAGGGAUUC | 299 | 2022-2044 |
| AD-1302896 | AGCAGAGGAAGGCCUUGCUGU | 165 | 2031-2051 | ACAGCAAGGCCUUCCUCUGCUGA | 300 | 2029-2051 |
| AD-1302897 | CAGUGUCUCCGAGAACUCCCU | 166 | 2074-2094 | AGGGAGUUCUCGGAGACACUGCG | 301 | 2072-2094 |
| AD-1302898 | UCCGAGAACUCCCUCGUGGCU | 167 | 2081-2101 | AGCCACGAGGGAGUUCUCGGAGA | 302 | 2079-2101 |
| AD-1302899 | ACUCCCUCGUGGCAAUGGAUU | 168 | 2088-2108 | AAUCCAUUGCCACGAGGGAGUUC | 303 | 2086-2108 |
| AD-1302900 | UUCUGGGCAAACAGGACGCGU | 169 | 2110-2130 | ACGCGUCCUGUUUGCCCAGAAAA | 304 | 2108-2130 |
| AD-1302901 | CAAACAGGACGCGUGAUAGAU | 170 | 2117-2137 | AUCUAUCACGCGUCCUGUUUGCC | 305 | 2115-2137 |
| AD-1302902 | GACGCGUGAUAGAGAAUCCGU | 171 | 2124-2144 | ACGGAUUCUCUAUCACGCGUCCU | 306 | 2122-2144 |
| AD-1302903 | GAUAGAGAAUCCGGCAGAGGU | 172 | 2131-2151 | ACCUCUGCCGGAUUCUCUAUCAC | 307 | 2129-2151 |
| AD-1302904 | AAUCCGGCAGAGGCCCAGAGU | 173 | 2138-2158 | ACUCUGGGCCUCUGCCGGAUUCU | 308 | 2136-2158 |
| AD-1302905 | GCGAAGCACACGGAUGAACAU | 174 | 2191-2211 | AUGUUCAUCCGUGUGCUUCGCUU | 309 | 2189-2211 |
| AD-1302906 | ACACGGAUGAACAUCCUAGGU | 175 | 2198-2218 | ACCUAGGAUGUUCAUCCGUGUGC | 310 | 2196-2218 |
| AD-1302907 | UGAACAUCCUAGGUAGCCAAU | 176 | 2205-2225 | AUUGGCUACCUAGGAUGUUCAUC | 311 | 2203-2225 |

TABLE 3-continued

Human Unmodified Sense and Antisense Strand Sequences of GRB10 dsRNA Agents that use GalNAc Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1302908 | CUCCACCCUUCUACCCUAAGU | 177 | 2231-2251 | ACUUAGGGUAGAAGGGUGGAGGG | 312 | 2229-2251 |
| AD-1302909 | AUUCACAGGACACAGCACUGU | 178 | 2258-2278 | ACAGUGCUGUGUCCUGUGAAUCA | 313 | 2256-2278 |
| AD-1302910 | GGACACAGCACUGGUUUCACU | 179 | 2265-2285 | AGUGAAACCAGUGCUGUGUCCUG | 314 | 2263-2285 |
| AD-1302911 | GCACUGGUUUCACGGGAGGAU | 180 | 2272-2292 | AUCCUCCCGUGAAACCAGUGCUG | 315 | 2270-2292 |
| AD-1302912 | UUUCACGGGAGGAUCUCCAGU | 181 | 2279-2299 | ACUGGAGAUCCUCCCGUGAAACC | 316 | 2277-2299 |
| AD-1302913 | GGAGGAUCUCCAGGGAGGAAU | 182 | 2286-2306 | AUUCCUCCCUGGAGAUCCUCCCG | 317 | 2284-2306 |
| AD-1302914 | CUCCAGGGAGGAAUCCCACAU | 183 | 2293-2313 | AUGUGGGAUUCCUCCCUGGAGAU | 318 | 2291-2313 |
| AD-1302915 | GAGGAAUCCCACAGGAUCAUU | 184 | 2300-2320 | AAUGAUCCUGUGGGAUUCCUCCC | 319 | 2298-2320 |
| AD-1302916 | CCCACAGGAUCAUUAAACAGU | 185 | 2307-2327 | ACUGUUUAAUGAUCCUGUGGGAU | 320 | 2305-2327 |
| AD-1302917 | GAUCAUUAAACAGCAAGGGCU | 186 | 2314-2334 | AGCCCUUGCUGUUUAAUGAUCCU | 321 | 2312-2334 |
| AD-1302918 | AAACAGCAAGGGCUCGUGGAU | 187 | 2321-2341 | AUCCACGAGCCCUUGCUGUUUAA | 322 | 2319-2341 |

TABLE 4

Human Unmodified Sense and Antisense Strand Sequences of GRB10 dsRNA Agents that use C16 Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1364730 | GCCUUCAGGAGGAAGACCAGA | 1968 | 1164-1184 | UCUGGUCUUCCUCCUGAAGGCGC | 2103 | 1162-1184 |
| AD-1365058 | GUCUUUAGUGAAGAUGGGACA | 1969 | 1313-1333 | UGUCCCAUCUUCACUAAAGACUU | 2104 | 1311-1333 |
| AD-1365135 | GGUUUACAAAAGUCACUGUGA | 1970 | 1390-1410 | UCACAGUGACUUUUGUAAACCAG | 2105 | 1388-1410 |
| AD-1365142 | AAAAGUCACUGUGUGGAUGAA | 1971 | 1397-1417 | UUCAUCCACACAGUGACUUUUGU | 2106 | 1395-1417 |
| AD-365149 | ACUGUGUGGAUGACAACAGCA | 1972 | 1404-1424 | UGCUGUUGUCAUCCACACAGUGA | 2107 | 1402-1424 |
| AD-1365491 | ACCCAGACACCUGCAGCUGCA | 1973 | 1786-1806 | UGCAGCUGCAGGUGUCUGGGUUC | 2108 | 1784-1806 |
| AD-1416437 | CAAGGUGGAGCAGACACCUCA | 1974 | 853-873 | UGAGGUGUCUGCUCCACCUUGUC | 2109 | 851-873 |
| AD-1416444 | GAGCAGACACCUCGCAGUCAA | 1975 | 860-880 | UUGACUGCGAGGUGUCUGCUCCA | 2110 | 858-880 |
| AD-1416451 | CACCUCGCAGUCAACAAGACA | 1976 | 867-887 | UGUCUUGUUGACUGCGAGGUGUC | 2111 | 865-887 |
| AD-1416458 | CAGUCAACAAGACCCGGCAGA | 1977 | 874-894 | UCUGCCGGGUCUUGUUGACUGCG | 2112 | 872-894 |

TABLE 4-continued

Human Unmodified Sense and Antisense Strand Sequences of GRB10 dsRNA Agents that use C16 Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1416465 | CAAGACCCGGCAGGACCAGGA | 1978 | 881-901 | UCCUGGUCCUGCCGGGUCUUGUU | 2113 | 879-901 |
| AD-1416471 | CGCACAGUCUGACCGACUUGA | 1979 | 907-927 | UCAAGUCGGUCAGACUGUGCGGG | 2114 | 905-927 |
| AD-1416478 | UCUGACCGACUUGCGAAUCAA | 1980 | 914-934 | UUGAUUCGCAAGUCGGUCAGACU | 2115 | 912-934 |
| AD-1416505 | GAUGAUGUGGACCUGGAAGCA | 1981 | 941-961 | UGCUUCCAGGUCCACAUCAUCCU | 2116 | 939-961 |
| AD-1416512 | UGGACCUGGAAGCCCUGGUGA | 1982 | 948-968 | UCACCAGGGCUUCCAGGUCCACA | 2117 | 946-968 |
| AD-1416519 | GGAAGCCCUGGUGAACGAUAA | 1983 | 955-975 | UUAUCGUUCACCAGGGCUUCCAG | 2118 | 953-975 |
| AD-1416526 | CUGGUGAACGAUAUGAAUGCA | 1984 | 962-982 | UGCAUUCAUAUCGUUCACCAGGG | 2119 | 960-982 |
| AD-1416533 | ACGAUAUGAAUGCAUCCCUGA | 1985 | 969-989 | UCAGGGAUGCAUUCAUAUCGUUC | 2120 | 967-989 |
| AD-1416540 | GAAUGCAUCCCUGGAGAGCCA | 1986 | 976-996 | UGGCUCUCCAGGGAUGCAUUCAU | 2121 | 974-996 |
| AD-1416547 | UCCCUGGAGAGCCUGUACUCA | 1987 | 983-1003 | UGAGUACAGGCUCUCCAGGGAUG | 2122 | 981-1003 |
| AD-1416555 | GAGCCUGUACUCGGCCUGCAA | 1988 | 991-1011 | UUGCAGGCCGAGUACAGGCUCUC | 2123 | 989-1011 |
| AD-1416562 | UACUCGGCCUGCAGCAUGCAA | 1989 | 998-1018 | UUGCAUGCUGCAGGCCGAGUACA | 2124 | 996-1018 |
| AD-1416569 | CCUGCAGCAUGCAGUCAGACA | 1990 | 1005-1025 | UGUCUGACUGCAUGCUGCAGGCC | 2125 | 1003-1025 |
| AD-1416576 | CAUGCAGUCAGACACGGUGCA | 1991 | 1012-1032 | UGCACCGUGUCUGACUGCAUGCU | 2126 | 1010-1032 |
| AD-1416578 | CUCCUGCAGAAUGGCCAGCAA | 1992 | 1034-1054 | UUGCUGGCCAUUCUGCAGGAGGG | 2127 | 1032-1054 |
| AD-1416586 | GAAUGGCCAGCAUGCCCGCAA | 1993 | 1042-1062 | UUGCGGGCAUGCUGGCCAUUCUG | 2128 | 1040-1062 |
| AD-1416611 | UCAGGCCCUCCUCGGUCCAUA | 1994 | 1076-1096 | UAUGGACCGAGGAGGGCCUGAAG | 2129 | 1074-1096 |
| AD-1416620 | CCUCGGUCCAUCCAGCCACAA | 1995 | 1085-1105 | UUGUGGCUGGAUGGACCGAGGAG | 2130 | 1083-1105 |
| AD-1416627 | CCAUCCAGCCACAGGUGUCCA | 1996 | 1092-1112 | UGGACACCUGUGGCUGGAUGGAC | 2131 | 1090-1112 |
| AD-1416645 | CGCUCCCAGCCUGUGCACAUA | 1997 | 1130-1150 | UAUGUGCACAGGCUGGGAGCGCU | 2132 | 1128-1150 |
| AD-1416652 | AGCCUGUGCACAUCCUCGCUA | 1998 | 1137-1157 | UAGCGAGGAUGUGCACAGGCUGG | 2133 | 1135-1157 |
| AD-1416674 | GGAGGAAGACCAGCAGUUUAA | 1999 | 1171-1191 | UUAAACUGCUGGUCUUCCUCCUG | 2134 | 1169-1191 |
| AD-1416681 | GACCAGCAGUUUAGAACCUCA | 2000 | 1178-1198 | UGAGGUUCUAAACUGCUGGUCUU | 2135 | 1176-1198 |
| AD-1416688 | AGUUUAGAACCUCAUCUCUGA | 2001 | 1185-1205 | UCAGAGAUGAGGUUCUAAACUGC | 2136 | 1183-1205 |
| AD-1416695 | AACCUCAUCUCUGCCGGCCAA | 2002 | 1192-1212 | UUGGCCGGCAGAGAUGAGGUUCU | 2137 | 1190-1212 |

TABLE 4-continued

Human Unmodified Sense and Antisense Strand Sequences of GRB10 dsRNA Agents that use C16 Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1416699 | CAAUCCUUUUCCUGAACUCUA | 2003 | 1216-1236 | UAGAGUUCAGGAAAAGGAUUGGG | 2138 | 1214-1236 |
| AD-1416706 | UUUCCUGAACUCUGUGGCCCA | 2004 | 1223-1243 | UGGGCCACAGAGUUCAGGAAAAG | 2139 | 1221-1243 |
| AD-1416713 | AACUCUGUGGCCCUGGGAGCA | 2005 | 1230-1250 | UGCUCCCAGGGCCACAGAGUUCA | 2140 | 1228-1250 |
| AD-1416716 | UGUGCUCACGCCGGGUUCUUA | 2006 | 1255-1275 | UAAGAACCCGGCGUGAGCACAGG | 2141 | 1253-1275 |
| AD-1416723 | ACGCCGGGUUCUUUACCUCCA | 2007 | 1262-1282 | UGGAGGUAAAGAACCCGGCGUGA | 2142 | 1260-1282 |
| AD-1416730 | GUUCUUUACCUCCGAGCCAGA | 2008 | 1269-1289 | UCUGGCUCGGAGGUAAAGAACCC | 2143 | 1267-1289 |
| AD-1416740 | AGCAAAGUGGUGGAGAUUCUA | 2009 | 1334-1354 | UAGAAUCUCCACCACUUUGCUUG | 2144 | 1332-1354 |
| AD-1416764 | UGUUAAAGUCUUUAGUGAAGA | 2010 | 1306-1326 | UCUUCACUAAAGACUUUAACAUC | 2145 | 1304-1326 |
| AD-1416774 | GUGAAGAUGGGACAAGCAAAA | 2011 | 1320-1340 | UUUUGCUUGUCCCAUCUUCACUA | 2146 | 1318-1340 |
| AD-1416781 | UGGGACAAGCAAAGUGGUGGA | 2012 | 1327-1347 | UCCACCACUUUGCUUGUCCCAUC | 2147 | 1325-1347 |
| AD-1416795 | UGGUGGAGAUUCUAGCAGACA | 2013 | 1341-1361 | UGUCUGCUAGAAUCUCCACCACU | 2148 | 1339-1361 |
| AD-1416802 | GAUUCUAGCAGACAUGACAGA | 2014 | 1348-1368 | UCUGUCAUGUCUGCUAGAAUCUC | 2149 | 1346-1368 |
| AD-1416809 | GCAGACAUGACAGCCAGAGAA | 2015 | 1355-1375 | UUCUCUGGCUGUCAUGUCUGCUA | 2150 | 1353-1375 |
| AD-1416816 | UGACAGCCAGAGACCUGUGCA | 2016 | 1362-1382 | UGCACAGGUCUCUGGCUGUCAUG | 2151 | 1360-1382 |
| AD-1416823 | CAGAGACCUGUGCCAAUUGCA | 2017 | 1369-1389 | UGCAAUUGGCACAGGUCUCUGGC | 2152 | 1367-1389 |
| AD-1416830 | CUGUGCCAAUUGCUGGUUUAA | 2018 | 1376-1396 | UUAAACCAGCAAUUGGCACAGGU | 2153 | 1374-1396 |
| AD-1416837 | AAUUGCUGGUUUACAAAAGUA | 2019 | 1383-1403 | UACUUUUGUAAACCAGCAAUUGG | 2154 | 1381-1403 |
| AD-1416841 | GGAUGACAACAGCUGGACACA | 2020 | 1411-1431 | UGUGUCCAGCUGUUGUCAUCCAC | 2155 | 1409-1431 |
| AD-1416848 | AACAGCUGGACACUAGUGGAA | 2021 | 1418-1438 | UUCCACUAGUGUCCAGCUGUUGU | 2156 | 1416-1438 |
| AD-1416855 | GGACACUAGUGGAGCACCACA | 2022 | 1425-1445 | UGUGGUGCUCCACUAGUGUCCAG | 2157 | 1423-1445 |
| AD-1416863 | GUGGAGCACCACCCGCACCUA | 2023 | 1433-1453 | UAGGUGCGGGUGGUGCUCCACUA | 2158 | 1431-1453 |
| AD-1416870 | ACCACCCGCACCUAGGAUUAA | 2024 | 1440-1460 | UUAAUCCUAGGUGCGGGUGGUGC | 2159 | 1438-1460 |
| AD-1416893 | AGGUGCUUGGAAGACCAUGAA | 2025 | 1463-1483 | UUCAUGGUCUUCCAAGCACCUCU | 2160 | 1461-1483 |
| AD-1416900 | UGGAAGACCAUGAGCUGGUGA | 2026 | 1470-1490 | UCACCAGCUCAUGGUCUUCCAAG | 2161 | 1468-1490 |

TABLE 4-continued

Human Unmodified Sense and Antisense Strand Sequences of GRB10 dsRNA Agents that use C16 Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1416907 | CCAUGAGCUGGUGGUCCAGGA | 2027 | 1477-1497 | UCCUGGACCACCAGCUCAUGGUC | 2162 | 1475-1497 |
| AD-1416914 | CUGGUGGUCCAGGUGGAGAGA | 2028 | 1484-1504 | UCUCUCCACCUGGACCACCAGCU | 2163 | 1482-1504 |
| AD-1416921 | UCCAGGUGGAGAGUACCAUGA | 2029 | 1491-1511 | UCAUGGUACUCUCCACCUGGACC | 2164 | 1489-1511 |
| AD-1416928 | GGAGAGUACCAUGGCCAGUGA | 2030 | 1498-1518 | UCACUGGCCAUGGUACUCUCCAC | 2165 | 1496-1518 |
| AD-1416935 | ACCAUGGCCAGUGAGAGUAAA | 2031 | 1505-1525 | UUUACUCUCACUGGCCAUGGUAC | 2166 | 1503-1525 |
| AD-1416942 | CCAGUGAGAGUAAAUUUCUAA | 2032 | 1512-1532 | UUAGAAAUUUACUCUCACUGGCC | 2167 | 1510-1532 |
| AD-1416949 | GAGUAAAUUUCUAUUCAGGAA | 2033 | 1519-1539 | UUCCUGAAUAGAAAUUUACUCUC | 2168 | 1517-1539 |
| AD-1416957 | UUCUAUUCAGGAAGAAUUACA | 2034 | 1527-1547 | UGUAAUUCUUCCUGAAUAGAAAU | 2169 | 1525-1547 |
| AD-1416964 | CAGGAAGAAUUACGCAAAAUA | 2035 | 1534-1554 | UAUUUUGCGUAAUUCUUCCUGAA | 2170 | 1532-1554 |
| AD-1416971 | AAUUACGCAAAAUACGAGUUA | 2036 | 1541-1561 | UAACUCGUAUUUUGCGUAAUUCU | 2171 | 1539-1561 |
| AD-1416978 | CAAAAUACGAGUUCUUUAAAA | 2037 | 1548-1568 | UUUUAAAGAACUCGUAUUUUGCG | 2172 | 1546-1568 |
| AD-1417009 | UUUCUUCCCAGAACAGAUGGA | 2038 | 1579-1599 | UCCAUCUGUUCUGGGAAGAAAUU | 2173 | 1577-1599 |
| AD-1417016 | CCAGAACAGAUGGUUACUUGA | 2039 | 1586-1606 | UCAAGUAACCAUCUGUUCUGGGA | 2174 | 1584-1606 |
| AD-1417023 | AGAUGGUUACUUGGUGCCAGA | 2040 | 1593-1613 | UCUGGCACCAAGUAACCAUCUGU | 2175 | 1591-1613 |
| AD-1417030 | UACUUGGUGCCAGCAGUCAAA | 2041 | 1600-1620 | UUUGACUGCUGGCACCAAGUAAC | 2176 | 1598-1620 |
| AD-1417037 | UGCCAGCAGUCAAAUGGCAGA | 2042 | 1607-1627 | UCUGCCAUUUGACUGCUGGCACC | 2177 | 1605-1627 |
| AD-1417044 | AGUCAAAUGGCAGUCAAACCA | 2043 | 1614-1634 | UGGUUUGACUGCCAUUUGACUGC | 2178 | 1612-1634 |
| AD-1417051 | UGGCAGUCAAACCCAGCUUUA | 2044 | 1621-1641 | UAAAGCUGGGUUUGACUGCCAUU | 2179 | 1619-1641 |
| AD-1417078 | UUUUCUGAACUCCAGUAGUUA | 2045 | 1648-1668 | UAACUACUGGAGUUCAGAAAAUU | 2180 | 1646-1668 |
| AD-1417085 | AACUCCAGUAGUUGUCCUGAA | 2046 | 1655-1675 | UUCAGGACAACUACUGGAGUUCA | 2181 | 1653-1675 |
| AD-1417092 | GUAGUUGUCCUGAAAUUCAAA | 2047 | 1662-1682 | UUUGAAUUUCAGGACAACUACUG | 2182 | 1660-1682 |
| AD-1417118 | UUGCAUGUGAAAGAGCUGGGA | 2048 | 1688-1708 | UCCCAGCUCUUUCACAUGCAAAA | 2183 | 1686-1708 |
| AD-1417125 | UGAAAGAGCUGGGAAAGAAAA | 2049 | 1695-1715 | UUUUCUUUCCCAGCUCUUUCACA | 2184 | 1693-1715 |
| AD-1417132 | GCUGGGAAAGAAAUCAUGGAA | 2050 | 1702-1722 | UUCCAUGAUUUCUUUCCCAGCUC | 2185 | 1700-1722 |
| AD-1417154 | AAGCUGUAUGUGUGUUUGCGA | 2051 | 1724-1744 | UCGCAAACACACAUACAGCUUUU | 2186 | 1722-1744 |

TABLE 4-continued

Human Unmodified Sense and Antisense Strand Sequences of GRB10 dsRNA Agents that use C16 Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1417161 | AUGUGUGUUUGCGGAGAUCUA | 2052 | 1731-1751 | UAGAUCUCCGCAAACACACAUAC | 2187 | 1729-1751 |
| AD-1417168 | UUUGCGGAGAUCUGGCCUUUA | 2053 | 1738-1758 | UAAAGGCCAGAUCUCCGCAAACA | 2188 | 1736-1758 |
| AD-1417175 | AGAUCUGGCCUUUAUUGCUCA | 2054 | 1745-1765 | UGAGCAAUAAAGGCCAGAUCUCC | 2189 | 1743-1765 |
| AD-1417182 | GCCUUUAUUGCUCCACCAAGA | 2055 | 1752-1772 | UCUUGGUGGAGCAAUAAAGGCCA | 2190 | 1750-1772 |
| AD-1417189 | UUGCUCCACCAAGGGAACUUA | 2056 | 1759-1779 | UAAGUUCCCUUGGUGGAGCAAUA | 2191 | 1757-1779 |
| AD-1417233 | GCCGACCUGGAGGACAGCAAA | 2057 | 1808-1828 | UUUGCUGUCCUCCAGGUCGGCCA | 2192 | 1806-1828 |
| AD-1417240 | UGGAGGACAGCAACAUCUUCA | 2058 | 1815-1835 | UGAAGAUGUUGCUGUCCUCCAGG | 2193 | 1813-1835 |
| AD-1417247 | CAGCAACAUCUUCUCCCUGAA | 2059 | 1822-1842 | UUCAGGGAGAAGAUGUUGCUGUC | 2194 | 1820-1842 |
| AD-1417254 | AUCUUCUCCCUGAUCGCUGGA | 2060 | 1829-1849 | UCCAGCGAUCAGGGAGAAGAUGU | 2195 | 1827-1849 |
| AD-1417261 | CCCUGAUCGCUGGCAGGAAGA | 2061 | 1836-1856 | UCUUCCUGCCAGCGAUCAGGGAG | 2196 | 1834-1856 |
| AD-1417268 | CGCUGGCAGGAAGCAGUACAA | 2062 | 1843-1863 | UUGUACUGCUUCCUGCCAGCGAU | 2197 | 1841-1863 |
| AD-1417275 | UACAGACCACGGGCUCUGCAA | 2063 | 1870-1890 | UUGCAGAGCCCGUGGUCUGUAGG | 2198 | 1868-1890 |
| AD-1417302 | AAACAAAGUCAGGAAUGAAAA | 2064 | 1897-1917 | UUUUCAUUCCUGACUUUGUUUGG | 2199 | 1895-1917 |
| AD-1417309 | GUCAGGAAUGAAACUAAAGAA | 2065 | 1904-1924 | UUCUUUAGUUUCAUUCCUGACUU | 2200 | 1902-1924 |
| AD-1417316 | AUGAAACUAAAGAGCUGAGGA | 2066 | 1911-1931 | UCCUCAGCUCUUUAGUUUCAUUC | 2201 | 1909-1931 |
| AD-1417323 | UAAAGAGCUGAGGUUGCUCUA | 2067 | 1918-1938 | UAGAGCAACCUCAGCUCUUUAGU | 2202 | 1916-1938 |
| AD-1417330 | CUGAGGUUGCUCUGUGCAGAA | 2068 | 1925-1945 | UUCUGCACAGAGCAACCUCAGCU | 2203 | 1923-1945 |
| AD-1417337 | UGCUCUGUGCAGAGGACGAGA | 2069 | 1932-1952 | UCUCGUCCUCUGCACAGAGCAAC | 2204 | 1930-1952 |
| AD-1417344 | UGCAGAGGACGAGCAAACCAA | 2070 | 1939-1959 | UUGGUUUGCUCGUCCUCUGCACA | 2205 | 1937-1959 |
| AD-1417351 | GACGAGCAAACCAGGACGUGA | 2071 | 1946-1966 | UCACGUCCUGGUUUGCUCGUCCU | 2206 | 1944-1966 |
| AD-1417358 | AAACCAGGACGUGCUGGAUGA | 2072 | 1953-1973 | UCAUCCAGCACGUCCUGGUUUGC | 2207 | 1951-1973 |
| AD-1417365 | GACGUGCUGGAUGACAGCGUA | 2073 | 1960-1980 | UACGCUGUCAUCCAGCACGUCCU | 2208 | 1958-1980 |
| AD-1417372 | UGGAUGACAGCGUUCAGACUA | 2074 | 1967-1987 | UAGUCUGAACGCUGUCAUCCAGC | 2209 | 1965-1987 |
| AD-1417401 | UGGAAUGCUCCUUUACCAGAA | 2075 | 1996-2016 | UUCUGGUAAAGGAGCAUUCCAUA | 2210 | 1994-2016 |

TABLE 4-continued

Human Unmodified Sense and Antisense Strand Sequences of GRB10 dsRNA Agents that use C16 Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1417408 | CUCCUUUACCAGAAUUACCGA | 2076 | 2003-2023 | UCGGUAAUUCUGGUAAAGGAGCA | 2211 | 2001-2023 |
| AD-1417415 | ACCAGAAUUACCGAAUCCCUA | 2077 | 2010-2030 | UAGGGAUUCGGUAAUUCUGGUAA | 2212 | 2008-2030 |
| AD-1417422 | UUACCGAAUCCCUCAGCAGAA | 2078 | 2017-2037 | UUCUGCUGAGGGAUUCGGUAAUU | 2213 | 2015-2037 |
| AD-1417429 | AUCCCUCAGCAGAGGAAGGCA | 2079 | 2024-2044 | UGCCUUCCUCUGCUGAGGGAUUC | 2214 | 2022-2044 |
| AD-1417436 | AGCAGAGGAAGGCCUUGCUGA | 2080 | 2031-2051 | UCAGCAAGGCCUUCCUCUGCUGA | 2215 | 2029-2051 |
| AD-1417459 | CAGUGUCUCCGAGAACUCCCA | 2081 | 2074-2094 | UGGGAGUUCUCGGAGACACUGCG | 2216 | 2072-2094 |
| AD-1417466 | UCCGAGAACUCCCUCGUGGCA | 2082 | 2081-2101 | UGCCACGAGGGAGUUCUCGGAGA | 2217 | 2079-2101 |
| AD-1417473 | ACUCCCUCGUGGCAAUGGAUA | 2083 | 2088-2108 | UAUCCAUUGCCACGAGGGAGUUC | 2218 | 2086-2108 |
| AD-1417495 | UUCUGGGCAAACAGGACGCGA | 2084 | 2110-2130 | UCGCGUCCUGUUUGCCCAGAAAA | 2219 | 2108-2130 |
| AD-1417502 | CAAACAGGACGCGUGAUAGAA | 2085 | 2117-2137 | UUCUAUCACGCGUCCUGUUUGCC | 2220 | 2115-2137 |
| AD-1417509 | GACGCGUGAUAGAGAAUCCGA | 2086 | 2124-2144 | UCGGAUUCUCUAUCACGCGUCCU | 2221 | 2122-2144 |
| AD-1417516 | GAUAGAGAAUCCGGCAGAGGA | 2087 | 2131-2151 | UCCUCUGCCGGAUUCUCUAUCAC | 2222 | 2129-2151 |
| AD-1417523 | AAUCCGGCAGAGGCCCAGAGA | 2088 | 2138-2158 | UCUCUGGGCCUCUGCCGGAUUCU | 2223 | 2136-2158 |
| AD-1417556 | GCGAAGCACACGGAUGAACAA | 2089 | 2191-2211 | UUGUUCAUCCGUGUGCUUCGCUU | 2224 | 2189-2211 |
| AD-1417563 | ACACGGAUGAACAUCCUAGGA | 2090 | 2198-2218 | UCCUAGGAUGUUCAUCCGUGUGC | 2225 | 2196-2218 |
| AD-1417570 | UGAACAUCCUAGGUAGCCAAA | 2091 | 2205-2225 | UUUGGCUACCUAGGAUGUUCAUC | 2226 | 2203-2225 |
| AD-1417576 | CUCCACCCUUCUACCCUAAGA | 2092 | 2231-2251 | UCUUAGGGUAGAAGGGUGGAGGG | 2227 | 2229-2251 |
| AD-1417603 | AUUCACAGGACACAGCACUGA | 2093 | 2258-2278 | UCAGUGCUGUGUCCUGUGAAUCA | 2228 | 2256-2278 |
| AD-1417610 | GGACACAGCACUGGUUUCACA | 2094 | 2265-2285 | UGUGAAACCAGUGCUGUGUCCUG | 2229 | 2263-2285 |
| AD-1417617 | GCACUGGUUUCACGGGAGGAA | 2095 | 2272-2292 | UUCCUCCCGUGAAACCAGUGCUG | 2230 | 2270-2292 |
| AD-1417624 | UUUCACGGGAGGAUCUCCAGA | 2096 | 2279-2299 | UCUGGAGAUCCUCCCGUGAAACC | 2231 | 2277-2299 |
| AD-1417631 | GGAGGAUCUCCAGGGAGGAAA | 2097 | 2286-2306 | UUUCCUCCCUGGAGAUCCUCCCG | 2232 | 2284-2306 |
| AD-1417638 | CUCCAGGGAGGAAUCCCACAA | 2098 | 2293-2313 | UUGUGGGAUUCCUCCCUGGAGAU | 2233 | 2291-2313 |
| AD-1417645 | GAGGAAUCCCACAGGAUCAUA | 2099 | 2300-2320 | UAUGAUCCUGUGGGAUUCCUCCC | 2234 | 2298-2320 |
| AD-1417652 | CCCACAGGAUCAUUAAACAGA | 2100 | 2307-2327 | UCUGUUUAAUGAUCCUGUGGGAU | 2235 | 2305-2327 |

TABLE 4-continued

Human Unmodified Sense and Antisense Strand Sequences of GRB10 dsRNA Agents that use C16 Ligand

| Duplex ID | Sense Sequence 5' to 3' | SEQ ID NO: | Range in NM_001350814.2 | Antisense Sequence 5' to 3' | SEQ ID NO: | Range in NM_001350814.2 |
|---|---|---|---|---|---|---|
| AD-1417659 | GAUCAUUAAACAGCAAGGGCA | 2101 | 2314-2334 | UGCCCUUGCUGUUUAAUGAUCCU | 2236 | 2312-2334 |
| AD-1417666 | AAACAGCAAGGGCUCGUGGAA | 2102 | 2321-2341 | UUCCACGAGCCCUUGCUGUUUAA | 2237 | 2319-2341 |

TABLE 5

Human Modified Sense and Antisense Strand Sequences of GRB10 dsRNA Agents that use GalNAc Ligand

| Duplex ID | Sense Sequence 5′ to 3′ | SEQ ID NO: | Antisense Sequence 5′ to 3′ | SEQ ID NO: | m RNA Target Sequence 5′ to 3′ | SEQ ID NO: |
|---|---|---|---|---|---|---|
| AD-1302784 | csasagguGfgAfGfCfagacaccucuL96 | 323 | asGfsaggUfgUfCfugcuCfcAfccuugsusc | 458 | GACAAGGUGGAGCAGACACCUCG | 593 |
| AD-1302785 | gsasgcagAfcAfCfCfucgcagucauL96 | 324 | asUfsgacUfgCfGfagguGfuCfugcucscsa | 459 | UGGAGCAGACACCUCGCAGUCAA | 594 |
| AD-1302786 | csasccucGfcAfGfUfcaacaagacuL96 | 325 | asGfsucuUfgUfUfgacuGfcGfaggugsusc | 460 | GACACCUCGCAGUCAACAAGACC | 595 |
| AD-1302787 | csasgucaAfcAfAfGfacccggcaguL96 | 326 | asCfsugcCfgGfGfucuuGfuUfgacugscsg | 461 | CGCAGUCAACAAGACCCGGCAGG | 596 |
| AD-1302788 | csasagacCfcGfGfCfaggaccagguL96 | 327 | asCfscugGfuCfCfugccGfgGfucuugsusu | 462 | AACAAGACCCGGCAGGACCAGGA | 597 |
| AD-1302789 | csgscacaGfuCfUfGfaccgacuuguL96 | 328 | asCfsaagUfcGfGfucagAfcUfgugcgsgsg | 463 | CCCGCACAGUCUGACCGACUUGC | 598 |
| AD-1302790 | uscsugacCfgAfCfUfugcgaaucauL96 | 329 | asUfsgauUfcGfCfaaguCfgGfucagascsu | 464 | AGUCUGACCGACUUGCGAAUCAC | 599 |
| AD-1302791 | gsasugauGfuGfGfAfccuggaagcuL96 | 330 | asGfscuuCfcAfGfguccAfcAfucaucscsu | 465 | AGGAUGAUGUGGACCUGGAAGCC | 600 |
| AD-1302792 | usgsgaccUfgGfAfAfgcccugguguL96 | 331 | asCfsaccAfgGfGfcuucCfaGfguccascsa | 466 | UGUGGACCUGGAAGCCCUGGUGA | 601 |
| AD-1302793 | gsgsaagcCfcUfGfGfugaacgauauL96 | 332 | asUfsaucGfuUfCfaccaGfgGfcuuccsasg | 467 | CUGGAAGCCCUGGUGAACGAUAU | 602 |
| AD-1302794 | csusggugAfaCfGfAfuaugaaugcuL96 | 333 | asGfscauUfcAfUfaucgUfuCfaccagsgsg | 468 | CCCUGGUGAACGAUAUGAAUGCA | 603 |
| AD-1302795 | ascsgauaUfgAfAfUfgcaucccuguL96 | 334 | asCfsaggGfaUfGfcauuCfaUfaucgususc | 469 | GAACGAUAUGAAUGCAUCCCUGG | 604 |
| AD-1302796 | gsasaugcAfuCfCfCfuggagagccuL96 | 335 | asGfsgcuCfuCfCfagggAfuGfcauucsasu | 470 | AUGAAUGCAUCCCUGGAGAGCCU | 605 |
| AD-1302797 | uscsccugGfaGfAfGfccuguacucuL96 | 336 | asGfsaguAfcAfGfgcucUfcCfagggasusg | 471 | CAUCCCUGGAGAGCCUGUACUCG | 606 |
| AD-1302798 | gsasgccuGfuAfCfUfcggccugcauL96 | 337 | asUfsgcaGfgCfCfgaguAfcAfggcucsusc | 472 | GAGAGCCUGUACUCGGCCUGCAG | 607 |
| AD-1302799 | usascucgGfcCfUfGfcagcaugcauL96 | 338 | asUfsgcaUfgCfUfgcagGfcCfgaguascsa | 473 | UGUACUCGGCCUGCAGCAUGCAG | 608 |
| AD-1302800 | cscsugcaGfcAfUfGfcagucagacuL96 | 339 | asGfsucuGfaCfUfgcauGfcUfgcaggscsc | 474 | GGCCUGCAGCAUGCAGUCAGACA | 609 |
| AD-1302801 | csasugcaGfuCfAfGfacacggugcuL96 | 340 | asGfscacCfgUfGfucugAfcUfgcaugscsu | 475 | AGCAUGCAGUCAGACACGGUGCC | 610 |

TABLE 5-continued

Human Modified Sense and Antisense Strand Sequences of GRB10 dsRNA Agents that use GalNAc Ligand

| Duplex ID | Sense Sequence 5' to 3' | SEQ ID NO: | Antisense Sequence 5' to 3' | SEQ ID NO: | m RNA Target Sequence 5' to 3' | SEQ ID NO: |
|---|---|---|---|---|---|---|
| AD-1302802 | csusccugCfaGfAfAfuggccagcauL96 | 341 | asUfsgcuGfgCfCfauucUfgCfaggagsgsg | 476 | CCCUCCUGCAGAAUGGCCAGCAU | 611 |
| AD-1302803 | gsasauggCfcAfGfCfaugcccgcauL96 | 342 | asUfsgcgGfgCfAfugcuGfgCfcauucsusg | 477 | CAGAAUGGCCAGCAUGCCCGCAG | 612 |
| AD-1302804 | uscsaggcCfcUfCfCfucgguccauuL96 | 343 | asAfsuggAfcCfGfaggaGfgGfccugasasg | 478 | CUUCAGGCCCUCCUCGGUCCAUC | 613 |
| AD-1302805 | cscsucggUfcCfAfUfccagccacauL96 | 344 | asUfsgugGfcUfGfgaugGfaCfcgaggsasg | 479 | CUCCUCGGUCCAUCCAGCCACAG | 614 |
| AD-1302806 | cscsauccAfgCfCfAfcaggugucuL96 | 345 | asGfsgacAfcCfUfguggCfuGfgauggsasc | 480 | GUCCAUCCAGCCACAGGUGUCCC | 615 |
| AD-1302807 | csgscuccCfaGfCfCfugugcacauuL96 | 346 | asAfsuguGfcAfCfaggcUfgGfgagcgscsu | 481 | AGCGCUCCCAGCCUGUGCACAUC | 616 |
| AD-1302808 | asgsccugUfgCfAfCfauccucgcuuL96 | 347 | asAfsgcgAfgGfAfugugCfaCfaggcusgsg | 482 | CCAGCCUGUGCACAUCCUCGCUG | 617 |
| AD-1302809 | gscscuucAfgGfAfGfgaagaccaguL96 | 348 | asCfsuggUfcUfUfccucCfuGfaaggcsgsc | 483 | GCGCCUUCAGGAGGAAGACCAGC | 618 |
| AD-1302810 | gsgsaggaAfgAfCfCfagcaguuuauL96 | 349 | asUfsaaaCfuGfCfuggucCfuUfccuccsusg | 484 | CAGGAGGAAGACCAGCAGUUUAG | 619 |
| AD-1302811 | gsasccagCfaGfUfUfuagaaccucuL96 | 350 | asGfsaggUfuCfUfaaacUfgCfuggucsusu | 485 | AAGACCAGCAGUUUAGAACCUCA | 620 |
| AD-1302812 | asgsuuuaGfaAfCfCfucaucucuguL96 | 351 | asCfsagaGfaUfGfagguUfcUfaaacusgsc | 486 | GCAGUUUAGAACCUCAUCUCUGC | 621 |
| AD-1302813 | asasccucAfuCfUfCfugccggccauL96 | 352 | asUfsggcCfgGfCfagagAfuGfagguuscsu | 487 | AGAACCUCAUCUCUGCCGGCCAU | 622 |
| AD-1302814 | csasauccUfuUfUfCfcugaacucuuL96 | 353 | asAfsgagUfuCfAfggaaAfaGfgauugsgsg | 488 | CCCAAUCCUUUUCCUGAACUCUG | 623 |
| AD-1302815 | ususuccuGfaAfCfUfcuguggcccuL96 | 354 | asGfsggcCfaCfAfgaguUfcAfggaaasasg | 489 | CUUUUCCUGAACUCUGUGGCCCU | 624 |
| AD-1302816 | asascucuGfuGfGfCfccugggagcuL96 | 355 | asGfscucCfcAfGfggccAfcAfgaguuscsa | 490 | UGAACUCUGUGGCCCUGGGAGCC | 625 |
| AD-1302817 | usgsugcuCfaCfGfCfcggguucuuuL96 | 356 | asAfsagaAfcCfCfggcgUfgAfgcacasgsg | 491 | CCUGUGCUCACGCCGGGUUCUUU | 626 |
| AD-1302818 | ascsgccgGfgUfUfCfuuuaccuccuL96 | 357 | asGfsgagGfuAfAfagaaCfcCfggcgusgsa | 492 | UCACGCCGGGUUCUUUACCUCCG | 627 |
| AD-1302819 | gsusucuuUfaCfCfUfccgagccaguL96 | 358 | asCfsuggCfuCfGfgaggUfaAfagaacscsc | 493 | GGGUUCUUUACCUCCGAGCCAGG | 628 |
| AD-1302820 | usgsuuaaAfgUfCfUfuuagugaaguL96 | 359 | asCfsuucAfcUfAfaagaCfuUfuaacasusc | 494 | GAUGUUAAAGUCUUUAGUGAAGA | 629 |
| AD-1302821 | gsuscuuuAfgUfGfAfagaugggacuL96 | 360 | asGfsuccCfaUfCfuucaCfuAfaagacsusu | 495 | AAGUCUUUAGUGAAGAUGGGACA | 630 |
| AD-1302822 | gsusgaagAfuGfGfGfacaagcaaauL96 | 361 | asUfsuugCfuUfGfucccAfuCfuucacsusa | 496 | UAGUGAAGAUGGGACAAGCAAAG | 631 |
| AD-1302823 | usgsggacAfaGfCfAfaaguggugguL96 | 362 | asCfscacCfaCfUfuugcUfuGfucccasusc | 497 | GAUGGGACAAGCAAAGUGGUGGA | 632 |
| AD-1302824 | asgscaaaGfuGfGfUfggagauucuuL96 | 363 | asAfsgaaUfcUfCfcaccAfcUfuugcusgsg | 498 | CAAGCAAAGUGGUGGAGAUUCUA | 633 |
| AD-1302825 | usgsguggAfgAfUfUfcuagcagacuL96 | 364 | asGfsucuGfcUfAfgaauCfuCfcaccascsu | 499 | AGUGGUGGAGAUUCUAGCAGACA | 634 |

TABLE 5-continued

Human Modified Sense and Antisense Strand Sequences of GRB10 dsRNA Agents that use GalNAc Ligand

| Duplex ID | Sense Sequence 5′ to 3′ | SEQ ID NO: | Antisense Sequence 5′ to 3′ | SEQ ID NO: | m RNA Target Sequence 5′ to 3′ | SEQ ID NO: |
|---|---|---|---|---|---|---|
| AD-1302826 | gsasuucuAfgCfAfGfacau gacaguL96 | 365 | asCfsuguCfaUfGfuc ugCfuAfgaaucsusc | 500 | GAGAUUCUAGCA GACAUGACAGC | 635 |
| AD-1302827 | gscsagacAfuGfAfCfagcca gagauL96 | 366 | asUfscucUfgGfCfu gucAfuGfucugcsusa | 501 | UAGCAGACAUGA CAGCCAGAGAC | 636 |
| AD-1302828 | usgsacagCfcAfGfAfgaccu gugcuL96 | 367 | asGfscacAfgGfUfcu cuGfgCfugucasusg | 502 | CAUGACAGCCAG AGACCUGUGCC | 637 |
| AD-1302829 | csasgagaCfcUfGfUfgccaa uugcuL96 | 368 | asGfscaaUfuGfGfca caGfgUfcucugsgsc | 503 | GCCAGAGACCUG UGCCAAUUGCU | 638 |
| AD-1302830 | csusgugcCfaAfUfUfgcug guuuauL96 | 369 | asUfsaaaCfcAfGfca auUfgGfcacagsgsu | 504 | ACCUGUGCCAAU UGCUGGUUUAC | 639 |
| AD-1302831 | asasuugcUfgGfUfUfuacaa aaguuL96 | 370 | asAfscuuUfuGfUfa aacCfaGfcaauusgsg | 505 | CCAAUUGCUGGU UUACAAAAGUC | 640 |
| AD-1302832 | gsgsuuuaCfaAfAfAfguca cuguguL96 | 371 | asCfsacaGfuGfAfcu uuUfgUfaaaccsasg | 506 | CUGGUUUACAAA AGUCACUGUGU | 641 |
| AD-1302833 | sasaaguCfaCfUfGfugugg augauL96 | 372 | asUfscauCfcAfCfac agUfgAfcuuuusgsu | 507 | ACAAAAGUCACU GUGUGGAUGAC | 642 |
| AD-1302834 | ascsugugUfgGfAfUfgaca acagcuL96 | 373 | asGfscugUfuGfUfc aucCfaCfacagusgsa | 508 | UCACUGUGUGGA UGACAACAGCU | 643 |
| AD-1302835 | gsgsaugaCfaAfCfAfgcug gacacuL96 | 374 | asGfsuguCfcAfGfc uguUfgUfcauccsasc | 509 | GUGGAUGACAAC AGCUGGACACU | 644 |
| AD-1302836 | asascagcUfgGfAfCfacuag uggauL96 | 375 | asUfsccaCfuAfGfug ucCfaGfcuguusgsu | 510 | ACAACAGCUGGA CACUAGUGGAG | 645 |
| AD-1302837 | gsgsacacUfaGfUfGfgagca ccacuL96 | 376 | asGfsuggUfgCfUfc cacUfaGfuguccsasg | 511 | CUGGACACUAGU GGAGCACCACC | 646 |
| AD-1302838 | gsusggagCfaCfCfAfcccgc accuuL96 | 377 | asAfsgguGfcGfGfg uggUfgCfuccacsusa | 512 | UAGUGGAGCACC ACCCGCACCUA | 647 |
| AD-1302839 | ascscaccCfgCfAfCfcuagg auuauL96 | 378 | asUfsaauCfcUfAfgg ugCfgGfguggusgsc | 513 | GCACCACCCGCA CCUAGGAUUAG | 648 |
| AD-1302840 | asgsgugcUfuGfGfAfagac caugauL96 | 379 | asUfscauGfgUfCfu uccAfaGfcaccuscsu | 514 | AGAGGUGCUUGG AAGACCAUGAG | 649 |
| AD-1302841 | sgsgaagAfcCfAfUfgagc ugguguL96 | 380 | asCfsaccAfgCfUfca ugGfuCfuuccasasg | 515 | CUUGGAAGACCA UGAGCUGGUGG | 650 |
| AD-1302842 | cscsaugaGfcUfGfGfuggu ccagguL96 | 381 | asCfscugGfaCfCfac caGfcUfcauggsusc | 516 | GACCAUGAGCUG GUGGUCCAGGU | 651 |
| AD-1302843 | csusggugGfuCfCfAfggug gagaguL96 | 382 | asCfsucuCfcAfCfcu ggAfcCfaccagscsu | 517 | AGCUGGUGGUCC AGGUGGAGAGU | 652 |
| AD-1302844 | uscscaggUfgGfAfGfagua ccauguL96 | 383 | asCfsaugGfuAfCfuc ucCfaCfcuggascsc | 518 | GGUCCAGGUGGA GAGUACCAUGG | 653 |
| AD-1302845 | gsgsagagUfaCfCfAfuggcc aguguL96 | 384 | asCfsacuGfgCfCfau ggUfaCfucuccsasc | 519 | GUGGAGAGUACC AUGGCCAGUGA | 654 |
| AD-1302846 | ascscaugGfcCfAfGfugaga guaauL96 | 385 | asUfsuacUfcUfCfac ugGfcCfauggusasc | 520 | GUACCAUGGCCA GUGAGAGUAAA | 655 |
| AD-1302847 | cscsagugAfgAfGfUfaaau uucuauL96 | 386 | asUfsagaAfuUfUfua cuCfuCfacuggscsc | 521 | GGCCAGUGAGAG UAAAUUUCUAU | 656 |
| AD-1302848 | gsasguaaAfuUfUfCfuauu caggauL96 | 387 | asUfsccuGfaAfUfag aaAfuUfuacucsusc | 522 | GAGAGUAAAUU UCUAUUCAGGAA | 657 |
| AD-1302849 | ususcuauUfcAfGfGfaagaa uuacuL96 | 388 | asGfsuaaUfuCfUfuc cuGfaAfuagaasasu | 523 | AUUUCUAUUCAG GAAGAAUUACG | 658 |

TABLE 5-continued

Human Modified Sense and Antisense Strand Sequences of GRB10 dsRNA Agents that use GalNAc Ligand

| Duplex ID | Sense Sequence 5' to 3' | SEQ ID NO: | Antisense Sequence 5' to 3' | SEQ ID NO: | m RNA Target Sequence 5' to 3' | SEQ ID NO: |
|---|---|---|---|---|---|---|
| AD-1302850 | csasggaaGfaAfUfUfacgcaaaauuL96 | 389 | asAfsuuuUfgCfGfuaauUfcUfuccugsasa | 524 | UUCAGGAAGAAUUACGCAAAAUA | 659 |
| AD-1302851 | asasuuacGfcAfAfAfauacgaguuuL96 | 390 | asAfsacuCfgUfAfuuuuGfcGfuaauuscsu | 525 | AGAAUUACGCAAAAUACGAGUUC | 660 |
| AD-1302852 | csasaaauAfcGfAfGfuucuuuaaauL96 | 391 | asUfsuuaAfaGfAfacucGfuAfuuuugscsg | 526 | CGCAAAAUACGAGUUCUUUAAAA | 661 |
| AD-1302853 | ususucuuCfcCfAfGfaacagauggul96 | 392 | asCfscauCfuGfUfucugGfgAfagaaasusu | 527 | AAUUUCUUCCCAGAACAGAUGGU | 662 |
| AD-1302854 | cscsagaaCfaGfAfUfgguuacuuguL96 | 393 | asCfsaagUfaAfCfcaucUfgUfucuggsgsa | 528 | UCCCAGAACAGAUGGUUACUUGG | 663 |
| AD-1302855 | asgsauggUfuAfCfUfugguqccaguL96 | 394 | asCfsuggCfaCfCfaaguAfaCfcaucusgsu | 529 | ACAGAUGGUUACUUGGUGCCAGC | 664 |
| AD-1302856 | usascuugGfuGfCfCfagcagucaauL96 | 395 | asUfsugaCfuGfCfuggcAfcCfaaguasasc | 530 | GUUACUUGGUGCCAGCAGUCAAA | 665 |
| AD-1302857 | usgsccagCfaGfUfCfaaauggcaguL96 | 396 | asCfsugcCfaUfUfugacUfgCfuggcascsc | 531 | GGUGCCAGCAGUCAAAUGGCAGU | 666 |
| AD-1302858 | asgsucaaAfuGfGfCfagucaaaccuL96 | 397 | asGfsguuUfgAfCfugccAfuUfugacusgsc | 532 | GCAGUCAAAUGGCAGUCAAACCC | 667 |
| AD-1302859 | usgsgcagUfcAfAfAfcccagcuuuuL96 | 398 | asAfsaagCfuGfGfguuuGfaCfugccasusu | 533 | AAUGGCAGUCAAACCCAGCUUUU | 668 |
| AD-1302860 | ususuucuGfaAfCfUfccaguaguuuL96 | 399 | asAfsacuAfcUfGfgaguUfcAfgaaaasusu | 534 | AAUUUUCUGAACUCCAGUAGUUG | 669 |
| AD-1302861 | asascuccAfgUfAfGfuuguccugauL96 | 400 | asUfscagGfaCfAfacuaCfuGfgaguuscsa | 535 | UGAACUCCAGUAGUUGUCCUGAA | 670 |
| AD-1302862 | gsusaguuGfuCfCfUfgaaauucaauL96 | 401 | asUfsugaAfuUfUfcaggAfcAfacuacsusg | 536 | CAGUAGUUGUCCUGAAAUUCAAG | 671 |
| AD-1302863 | ususgcauGfuGfAfAfagagcuggguL96 | 402 | asCfsccaGfcUfCfuuucAfcAfugcaasasa | 537 | UUUUGCAUGUGAAAGAGCUGGGA | 672 |
| AD-1302864 | usgsaaagAfgCfUfGfggaaagaaauL96 | 403 | asUfsuucUfuUfCfccagCfuCfuuucascsa | 538 | UGUGAAAGAGCUGGGAAAGAAAU | 673 |
| AD-1302865 | gscsugggAfaAfGfAfaaucauggauL96 | 404 | asUfsccaUfgAfUfuucuUfuCfccagcsusc | 539 | GAGCUGGGAAAGAAAUCAUGGAA | 674 |
| AD-1302866 | asasgcugUfaUfGfUfguguuugcguL96 | 405 | asCfsgcaAfaCfAfcacaUfaCfagcuususu | 540 | AAAAGCUGUAUGUGUGUUUGCGG | 675 |
| AD-1302867 | asusguguGfuUfUfGfcggagaucuuL96 | 406 | asAfsgauCfuCfCfgcaaAfcAfcacausasc | 541 | GUAUGUGUGUUUGCGGAGAUCUG | 676 |
| AD-1302868 | ususugcgGfaGfAfUfcuggccuuuuL96 | 407 | asAfsaagGfcCfAfgaucUfcCfgcaaascsa | 542 | UGUUUGCGGAGAUCUGGCCUUUA | 677 |
| AD-1302869 | asgsaucuGfgCfCfUfuuauugcucuL96 | 408 | asGfsagcAfaUfAfaaggCfcAfgaucuscsc | 543 | GGAGAUCUGGCCUUUAUUGCUCC | 678 |
| AD-1302870 | gscscuuuAfuUfGfCfuccaccaaguL96 | 409 | asCfsuugGfuGfGfagcaAfuAfaaggcscsa | 544 | UGGCCUUUAUUGCUCCACCAAGG | 679 |
| AD-1302871 | ususgcucCfaCfCfAfagggaacuuuL96 | 410 | asAfsaguUfcCfCfuuggUfgGfagcaasusa | 545 | UAUUGCUCCACCAAGGGAACUUC | 680 |
| AD-1302872 | ascsccagAfcAfCfCfugcagcugcuL96 | 411 | asGfscagCfuGfCfagguGfuCfugggususc | 546 | GAACCCAGACACCUGCAGCUGCU | 681 |

TABLE 5-continued

Human Modified Sense and Antisense Strand Sequences of GRB10 dsRNA Agents that use GalNAc Ligand

| Duplex ID | Sense Sequence 5' to 3' | SEQ ID NO: | Antisense Sequence 5' to 3' | SEQ ID NO: | m RNA Target Sequence 5' to 3' | SEQ ID NO: |
|---|---|---|---|---|---|---|
| AD-1302873 | gscscgacCfuGfGfAfggaca gcaauL96 | 412 | asUfsugcUfgUfCfc uccAfgGfucggcscsa | 547 | UGGCCGACCUGG AGGACAGCAAC | 682 |
| AD-1302874 | usgsgaggAfcAfGfCfaacau cuucuL96 | 413 | asGfsaagAfuGfUfu gcuGfuCfcuccasgsg | 548 | CCUGGAGGACAG CAACAUCUUCU | 683 |
| AD-1302875 | csasgcaaCfaUfCfUfucucc cugauL96 | 414 | asUfscagGfgAfGfaa gaUfgUfugcugsusc | 549 | GACAGCAACAUC UUCUCCCUGAU | 684 |
| AD-1302876 | asuscuucUfcCfCfUfgaucg cugguL96 | 415 | asCfscagCfgAfUfca ggGfaGfaagausgsu | 550 | ACAUCUUCUCCC UGAUCGCUGGC | 685 |
| AD-1302877 | cscscugaUfcGfCfUfggcag gaaguL96 | 416 | asCfsuucCfuGfCfca gcGfaUfcagggsasg | 551 | CUCCCUGAUCGC UGGCAGGAAGC | 686 |
| AD-1302878 | csgscuggCfaGfGfAfagcag uacauL96 | 417 | asUfsguaCfuGfCfu uccUfgCfcagcgsasu | 552 | AUCGCUGGCAGG AAGCAGUACAA | 687 |
| AD-1302879 | usascagaCfcAfCfGfggcuc ugcauL96 | 418 | asUfsgcaGfaGfCfcc guGfgUfcuguasgsg | 553 | CCUACAGACCAC GGGCUCUGCAU | 688 |
| AD-1302880 | asasacaaAfgUfCfAfggaau gaaauL96 | 419 | asUfsuucAfuUfCfc ugaCfuUfuguuusgs g | 554 | CCAAACAAAGUC AGGAAUGAAAC | 689 |
| AD-1302881 | gsuscaggAfaUfGfAfaacua aagauL96 | 420 | asUfscuuUfaGfUfu ucaUfuCfcugacsusu | 555 | AAGUCAGGAAUG AAACUAAAGAG | 690 |
| AD-1302882 | asusgaaaCfuAfAfAfgagcu gagguL96 | 421 | asCfscucAfgCfUfcu uuAfgUfuucausuc | 556 | GAAUGAAACUAA AGAGCUGAGGU | 691 |
| AD-1302883 | usasaagaGfcUfGfAfgguu gcucuuL96 | 1422 | asAfsgagCfaAfCfcu caGfcUfcuuuasgsu | 557 | ACUAAAGAGCUG AGGUUGCUCUG | 692 |
| AD-1302884 | csusgaggUfuGfCfUfcugu gcagauL96 | 1423 | asUfscugCfaCfAfga gcAfaCfcucagscsu | 558 | AGCUGAGGUUGC UCUGUGCAGAG | 693 |
| AD-1302885 | usgscucuGfuGfCfAfgagg acgaguL96 | 424 | asCfsucgUfcCfUfcu gcAfcAfgagcasasc | 559 | GUUGCUCUGUGC AGAGGACGAGC | 694 |
| AD-1302886 | usgscagaGfgAfCfGfagcaa accauL96 | 425 | asUfsgguUfuGfCfu cguCfcUfcugcascsa | 560 | UGUGCAGAGGAC GAGCAAACCAG | 695 |
| AD-1302887 | gsascgagCfaAfAfCfcagga cguguL96 | 426 | asCfsacgUfcCfUfgg uuUfgCfucgucscsu | 561 | AGGACGAGCAAA CCAGGACGUGC | 696 |
| AD-1302888 | asasaccaGfgAfCfGfugcug gauguL96 | 427 | asCfsaucCfaGfCfac guCfcUfgguuusgsc | 562 | GCAAACCAGGAC GUGCUGGAUGA | 697 |
| AD-1302889 | gsascgugCfuGfGfAfugac agcguuL96 | 428 | asAfscgcUfgUfCfau ccAfgCfacgucscsu | 563 | AGGACGUGCUGG AUGACAGCGUU | 698 |
| AD-1302890 | usgsgaugAfcAfGfCfguuc agacuuL96 | 429 | asAfsgucUfgAfAfc gcuGfuCfauccasgsc | 564 | GCUGGAUGACAG CGUUCAGACUC | 699 |
| AD-1302891 | usgsgaauGfcUfCfCfuuuac cagauL96 | 430 | asUfscugGfuAfAfa ggaGfcAfuuccasusa | 565 | UAUGGAAUGCUC CUUUACCAGAA | 700 |
| AD-1302892 | csusccuuUfaCfCfAfgaauu accguL96 | 431 | asCfsgguAfaUfUfc uggUfaAfaggagscsa | 566 | UGCUCCUUUACC AGAAUUACCGA | 701 |
| AD-1302893 | ascscagaAfuUfAfCfcgaau cccuuL96 | 432 | asAfsgggAfuUfCfg guaAfuUfcuggusasa | 567 | UUACCAGAAUUA CCGAAUCCCUC | 702 |
| AD-1302894 | ususaccgAfaUfCfCfcucag cagauL96 | 433 | asUfscugCfuGfAfg ggaUfuCfgguaasusu | 568 | AAUUACCGAAUC CCUCAGCAGAG | 703 |
| AD-1302895 | asusccucCfaGfCfAfgagga aggcuL96 | 434 | asGfsccuUfcCfUfcu gcUfgAfgggausuc | 569 | GAAUCCCUCAGC AGAGGAAGGCC | 704 |
| AD-1302896 | asgscagaGfgAfAfGfgccu ugcuguL96 | 435 | asCfsagcAfaGfGfcc uuCfcUfcugcusgsa | 570 | UCAGCAGAGGAA GGCCUUGCUGU | 705 |

TABLE 5-continued

Human Modified Sense and Antisense Strand Sequences of GRB10 dsRNA Agents that use GalNAc Ligand

| Duplex ID | Sense Sequence 5' to 3' | SEQ ID NO: | Antisense Sequence 5' to 3' | SEQ ID NO: | m RNA Target Sequence 5' to 3' | SEQ ID NO: |
|---|---|---|---|---|---|---|
| AD-1302897 | csasguguCfuCfCfGfagaac ucccuL96 | 436 | lasGfsggaGfuUfCfu cggAfgAfcacugscsg | 571 | CGCAGUGUCUCC GAGAACUCCCU | 706 |
| AD-1302898 | uscscgagAfaCfUfCfccucg uggcuL96 | 437 | asGfsccaCfgAfGfgg agUfuCfucggasgsa | 572 | UCUCCGAGAACU CCCUCGUGGCA | 707 |
| AD-1302899 | ascsucccUfcGfUfGfgcaau ggauuL96 | 438 | asAfsuccAfuUfGfcc acGfaGfggagususc | 573 | GAACUCCCUCGU GGCAAUGGAUU | 708 |
| AD-1302900 | ususcuggGfcAfAfAfcagg acgcguL96 | 439 | asCfsgcgUfcCfUfgu uuGfcCfcagaasasa | 574 | UUUUCUGGGCAA ACAGGACGCGU | 709 |
| AD-1302901 | csasaacaGfgAfCfGfcguga uagauL96 | 440 | asUfscuaUfcAfCfgc guCfcUfguuugscsc | 575 | GGCAAACAGGAC GCGUGAUAGAG | 710 |
| AD-1302902 | gsascgcgUfgAfUfAfgaga auccguL96 | 441 | asCfsggaUfuCfUfcu auCfaCfgcgucscsu | 576 | AGGACGCGUGAU AGAGAAUCCGG | 711 |
| AD-1302903 | gsasuagaGfaAfUfCfcggca gagguL96 | 442 | asCfscucUfgCfCfgg auUfcUfcuaucsasc | 577 | GUGAUAGAGAA UCCGGCAGAGGC | 712 |
| AD-1302904 | asasuccgGfcAfGfAfggccc agaguL96 | 443 | asCfsucuGfgGfCfcu cuGfcCfggauuscsu | 578 | AGAAUCCGGCAG AGGCCCAGAGC | 713 |
| AD-1302905 | gscsgaagCfaCfAfCfggaug aacauL96 | 444 | asUfsguuCfaUfCfcg ugUfgCfuucgcsusu | 579 | AAGCGAAGCACA CGGAUGAACAU | 714 |
| AD-1302906 | ascsacggAfuGfAfAfcaucc uagguL96 | 445 | asCfscuaGfgAfUfg uucAfuCfcgugusgsc | 580 | GCACACGGAUGA ACAUCCUAGGU | 715 |
| AD-1302907 | usgsaacaUfcCfUfAfgguag ccaauL96 | 446 | asUfsuggCfuAfCfc uagGfaUfguucasusc | 581 | GAUGAACAUCCU AGGUAGCCAAA | 716 |
| AD-1302908 | csusccacCfcUfUfCfuaccc uaaguL96 | 447 | asCfsuuaGfgGfUfa gaaGfgGfuggagsgsg | 582 | CCCUCCACCCUU CUACCCUAAGU | 717 |
| AD-1302909 | asusucacAfgGfAfCfacagc acuguL96 | 448 | asCfsaguGfcUfGfu gucCfuGfugaauscsa | 583 | UGAUUCACAGGA CACAGCACUGG | 718 |
| AD-1302910 | gsgsacacAfgCfAfCfuggu uucacuL96 | 449 | asGfsugaAfaCfCfag ugCfuGfuguccsusg | 584 | CAGGACACAGCA CUGGUUUCACG | 719 |
| AD-1302911 | gscsacugGfuUfUfCfacgg gaggauL96 | 450 | asUfsccuCfcCfGfug aaAfcCfagugcsusg | 585 | CAGCACUGGUUU CACGGGAGGAU | 720 |
| AD-1302912 | ususucacGfgGfAfGfgauc uccaguL96 | 451 | asCfsuggAfgAfUfc cucCfcGfugaaascsc | 586 | GGUUUCACGGGA GGAUCUCCAGG | 721 |
| AD-1302913 | gsgsaggaUfcUfCfCfaggga ggaauL96 | 452 | asUfsuccUfcCfCfug gaGfaUfccuccscsg | 587 | CGGGAGGAUCUC CAGGGAGGAAU | 722 |
| AD-1302914 | csusccagGfgAfGfGfaaucc cacauL96 | 453 | asUfsgugGfgAfUfu ccuCfcCfuggagsasu | 588 | AUCUCCAGGGAG GAAUCCCACAG | 723 |
| AD-1302915 | gsasggaaUfcCfCfAfcagga ucauuL96 | 454 | asAfsugaUfcCfUfg uggGfaUfuccucscsc | 589 | GGGAGGAAUCCC ACAGGAUCAUU | 724 |
| AD-1302916 | cscscacaGfgAfUfCfauuaa acaguL96 | 455 | asCfsuguUfuAfAfu gauCfcUfgugggsasu | 590 | AUCCCACAGGAU CAUUAAACAGC | 725 |
| AD-1302917 | gsasucauUfaAfAfCfagcaa gggcuL96 | 456 | asGfscccUfuGfCfug uuUfaAfugaucscsu | 591 | AGGAUCAUUAAA CAGCAAGGGCU | 726 |
| AD-1302918 | asasacagCfaAfGfGfgcucg uggauL96 | 457 | asUfsccaCfgAfGfcc cuUfgCfuguuusasa | 592 | UUAAACAGCAAG GGCUCGUGGAU | 727 |

TABLE 6

Human Modified Sense and Antisense Strand Sequences of GRB10 dsRNA Agents that use C16 Ligand

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1364730 | gscscuu(Chd)AfgGfAfGf gaagaccasgsa | 2238 | VPusCfsuggUfcUfU fccucCfuGfaaggcsgs c | 2373 | GCGCCUUCAGGA GGAAGACCAGC | 2508 |
| AD-1365058 | gsuscuu(Uhd)AfgUfGfAf agaugggascsa | 2239 | VPusGfsuccCfaUfCf uucaCfuAfaagacsusu | 2374 | AAGAUGGGACA AAGUCUUUAGUG | 2509 |
| AD-1365135 | gsgsuuu(Ahd)CfaAfAfAf gucacugusgsa | 2240 | VPusCfsacaGfuGfAf cuuuUfgUfaaaccsasg | 2375 | CUGGUUUACAAA AGUCACUGUGU | 2510 |
| AD-1365142 | asasaag(Uhd)CfaCfUfGfu guggaugsasa | 2241 | VPusUfscauCfcAfCf acagUfgAfcuuuusgs | 2376 | ACAAAAGUCACU GUGUGGAUGAC | 2511 |
| AD-1365149 | ascsugu(Ghd)UfgGfAfUf gacaacagscsa | 2242 | VPusGfscugUfuGfU fcaucCfaCfacagusgs a | 2377 | UCACUGUGUGGA UGACAACAGCU | 2512 |
| AD-1365491 | ascscca(Ghd)AfcAfCfCfu gcagcugscsa | 2243 | VPusGfscagCfuGfCf agguGfuCfugggusus c | 2378 | GAACCCAGACAC CUGCAGCUGCU | 2513 |
| AD-1416437 | csasagg(Uhd)GfgAfGfCfa gacaccuscsa | 2244 | VPusGfsaggUfgUfC fugcuCfcAfccuugsus c | 2379 | GACAAGGUGGAG CAGACACCUCG | 2514 |
| AD-1416444 | gsasgca(Ghd)AfcAfCfCfu cgcagucsasa | 2245 | VPusUfsgacUfgCfGf agguGfuCfugcucscsa | 2380 | UGGAGCAGACAC CUCGCAGUCAA | 2515 |
| AD-1416451 | csasccu(Chd)GfcAfGfUfc aacaagascsa | 2246 | VPusGfsucuUfgUfU fgacuGfcGfaggugsus c | 2381 | GACACCUCGCAG UCAACAAGACC | 2516 |
| AD-1416458 | csasguc(Ahd)AfcAfAfGfa cccggcasgsa | 2247 | VPusCfsugcCfgGfGf ucuuGfuUfgacugscs g | 2382 | CGCAGUCAACAA GACCCGGCAGG | 2517 |
| AD-1416465 | csasaga(Chd)CfcGfGfCfa ggaccagsgsa | 2248 | VPusCfscugGfuCfCf ugccGfgGfucuugsus u | 2383 | AACAAGACCCGG CAGGACCAGGA | 2518 |
| AD-1416471 | csgscac(Ahd)GfuCfUfGfa ccgacuusgsa | 2249 | VPusCfsaagUfcGfGf ucagAfcUfgugcgsgs g | 2384 | CCCGCACAGUCU GACCGACUUGC | 2519 |
| AD-1416478 | uscsuga(Chd)CfgAfCfUfu gcgaaucsasa | 2250 | VPusUfsgauUfcGfCf aaguCfgGfucagascsu | 2385 | AGUCUGACCGAC UUGCGAAUCAC | 2520 |
| AD-1416505 | gsasuga(Uhd)GfuGfGfAf ccuggaagscsa | 2251 | VPusGfscuuCfcAfGf guccAfcAfucaucscsu | 2386 | AGGAUGAUGUG GACCUGGAAGCC | 2521 |
| AD-1416512 | usgsgac(Chd)UfgGfAfAf gcccuggusgsa | 2252 | VPusCfsaccAfgGfGf cuucCfaGfguccascsa | 2387 | UGUGGACCUGGA AGCCCUGGUGA | 2522 |
| AD-1416519 | gsgsaag(Chd)CfcUfGfGfu gaacgausasa | 2253 | VPusUfsaucGfuUfCf accaGfgGfcuuccsasg | 2388 | CUGGAAGCCCUG GUGAACGAUAU | 2523 |
| AD-1416526 | csusggu(Ghd)AfaCfGfAf uaugaaugscsa | 2254 | VPusGfscauUfcAfUf aucgUfuCfaccagsgsg | 2389 | CCCUGGUGAACG AUAUGAAUGCA | 2524 |
| AD-1416533 | ascsgau(Ahd)UfgAfAfUf gcaucccusgsa | 2255 | VPusCfsaggGfaUfGf cauuCfaUfaucgusus c | 2390 | GAACGAUAUGAA UGCAUCCCUGG | 2525 |
| AD-1416540 | gsasaug(Chd)AfuCfCfCfu ggagagcscsa | 2256 | VPusGfsgcuCfuCfCf agggAfuGfcauucsasu | 2391 | AUGAAUGCAUCC CUGGAGAGCCU | 2526 |
| AD-1416547 | uscsccu(Ghd)GfaGfAfGfc cuguacuscsa | 2257 | VPusGfsaguAfcAfG fgcucUfcCfagggasus g | 2392 | CAUCCCUGGAGA GCCUGUACUCG | 2527 |

TABLE 6-continued

Human Modified Sense and Antisense Strand Sequences of GRB10 dsRNA Agents that use C16 Ligand

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1416555 | gsasgcc(Uhd)GfuAfCfUfc ggccugcsasa | 2258 | VPusUfsgcaGfgCfCf gaguAfcAfggcucsus | 2393 | GAGAGCCUGUAC UCGGCCUGCAG | 2528 |
| AD-1416562 | usascuc(Ghd)GfcCfUfGfc agcaugcsasa | 2259 | VPusUfsgcaUfgCfUf gcagGfcCfgaguascsa | 2394 | UGUACUCGGCCU GCAGCAUGCAG | 2529 |
| AD-1416569 | cscsugc(Ahd)GfcAfUfGfc agucagascsa | 2260 | VPusGfsucuGfaCfUf gcauGfcUfgcaggscsc | 2395 | GGCCUGCAGCAU GCAGUCAGACA | 2530 |
| AD-1416576 | csasugc(Ahd)GfuCfAfGfa cacggugscsa | 2261 | VPusGfscacCfgUfGf ucugAfcUfgcaugscsu | 2396 | AGCAUGCAGUCA GACACGGUGCC | 2531 |
| AD-1416578 | csusccu(Ghd)CfaGfAfAfu ggccagcsasa | 2262 | VPusUfsgcuGfgCfCf auucUfgCfaggagsgsg | 2397 | CCCUCCUGCAGA AUGGCCAGCAU | 2532 |
| AD-1416586 | gsasaug(Ghd)CfcAfGfCfa ugcccgcsasa | 2263 | VPusUfsgcgGfgCfA fugcuGfgCfcauucsus | 2398 | CAGAAUGGCCAG CAUGCCCGCAG | 2533 |
| AD-1416611 | uscsagg(Chd)CfcUfCfCfu cgguccasusa | 2264 | VPusAfsuggAfcCfG faggaGfgGfccugasas g | 2399 | CUUCAGGCCCUC CUCGGUCCAUC | 2534 |
| AD-1416620 | cscsucg(Ghd)UfcCfAfUfc cagccacsasa | 2265 | VPusUfsgugGfcUfG fgaugGfaCfcgaggsas g | 2400 | CUCCUCGGUCCA UCCAGCCACAG | 2535 |
| AD-1416627 | cscsauc(Chd)AfgCfCfAfc aggugucscsa | 2266 | VPusGfsgacAfcCfUf guggCfuGfgauggsas c | 2401 | GUCCAUCCAGCC ACAGGUGUCCC | 2536 |
| AD-1416645 | csgscuc(Chd)CfaGfCfCfu gugcacasusa | 2267 | VPusAfsuguGfcAfC faggcUfgGfgagcgscs u | 2402 | AGCGCUCCCAGC CUGUGCACAUC | 2537 |
| AD-1416652 | asgsccu(Ghd)UfgCfAfCfa uccucgcsusa | 2268 | VPusAfsgcgAfgGfA fugugCfaCfaggcusgs g | 2403 | CCAGCCUGUGCA CAUCCUCGCUG | 2538 |
| AD-1416674 | gsgsagg(Ahd)AfgAfCfCf agcaguuusasa | 2269 | VPusUfsaaaCfuGfCf ugguCfuUfccuccsusg | 2404 | CAGGAGGAAGAC CAGCAGUUUAG | 2539 |
| AD-1416681 | gsascca(Ghd)CfaGfUfUfu agaaccuscsa | 2270 | VPusGfsaggUfuCfU faaacUfgCfuggucsus u | 2405 | AAGACCAGCAGU UUAGAACCUCA | 2540 |
| AD-1416688 | asgsuuu(Ahd)GfaAfCfCf ucaucucusgsa | 2271 | VPusCfsagaGfaUfGf agguUfcUfaaacusgsc | 2406 | GCAGUUUAGAAC CUCAUCUCUGC | 2541 |
| AD-1416695 | asasccu(Chd)AfuCfUfCfu gccggccsasa | 2272 | VPusUfsggcCfgGfCf agagAfuGfagguuscs u | 2407 | AGAACCUCAUCU CUGCCGGCCAU | 2542 |
| AD-1416699 | csasauc(Chd)UfuUfUfCfc ugaacucsusa | 2273 | VPusAfsgagUfuCfA fggaaAfaGfgauugsgs g | 2408 | CCCAAUCCUUUU CCUGAACUCUG | 2543 |
| AD-1416706 | ususucc(Uhd)GfaAfCfUfc ugugggccscsa | 2274 | VPusGfsggcCfaCfAf gaguUfcAfggaaasasg | 2409 | CUUUUCCUGAAC UCUGUGGCCCU | 2544 |
| AD-1416713 | asascuc(Uhd)GfuGfGfCfc cugggagscsa | 2275 | VPusGfscucCfcAfGf ggccAfcAfgaguuscsa | 2410 | UGAACUCUGUGG CCCUGGGAGCC | 2545 |
| AD-1416716 | usgsugc(Uhd)CfaCfGfCfc ggguucusua | 2276 | VPusAfsagaAfcCfCf ggcgUfgAfgcacasgsg | 2411 | CCUGUGCUCACG CCGGGUUCUUU | 2546 |
| AD-1416723 | ascsgcc(Ghd)GfgUfUfCfu uuaccucscsa | 2277 | VPusGfsgagGfuAfA fagaaCfcCfggcgusgs a | 2412 | UCACGCCGGGUU CUUUACCUCCG | 2547 |

TABLE 6-continued

Human Modified Sense and Antisense Strand Sequences of GRB10 dsRNA Agents that use C16 Ligand

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1416730 | gsusucu(Uhd)UfaCfCfUfc cgagccasgsa | 2278 | VPusCfsuggCfuCfGf gaggUfaAfagaacscsc | 2413 | GGGUUCUUUACC UCCGAGCCAGG | 2548 |
| AD-1416740 | asgscaa(Ahd)GfuGfGfUf ggagauucsusa | 2279 | VPusAfsgaaUfcUfCf caccAfcUfuugcusugg | 2414 | CAAGCAAAGUGG UGGAGAUUCUA | 2549 |
| AD-1416764 | usgsuua(Ahd)AfgUfCfUf uuagugaasgsa | 2280 | VPusCfsuucAfcUfAf aagaCfuUfuaacasusc | 2415 | GAUGUUAAAGUC UUUAGUGAAGA | 2550 |
| AD-1416774 | gsusgaa(Ghd)AfuGfGfGf acaagcaasasa | 2281 | VPusUfsuugCfuUfG fucccAfuCfuucacsus | 2416 | UAGUGAAGAUG GGACAAGCAAAG | 2551 |
| AD-1416781 | usgsgga(Chd)AfaGfCfAfa aguggugsgsa | 2282 | VPusCfscacCfaCfUf uugcUfuGfucccasusc | 2417 | GAUGGGACAAGC AAAGUGGUGGA | 2552 |
| AD-1416795 | usgsgug(Ghd)AfgAfUfUf cuagcagascsa | 2283 | VPusGfsucuGfcUfA fgaauCfuCfcaccascs u | 2418 | AGUGGUGGAGA UUCUAGCAGACA | 2553 |
| AD-1416802 | gsasuuc(Uhd)AfgCfAfGf lacaugacasgsa | 2284 | VPusCfsuguCfaUfGf ucugCfuAfgaaucsusc | 2419 | GAGAUUCUAGCA GACAUGACAGC | 2554 |
| AD-1416809 | gscsaga(Chd)AfuGfAfCfa gccagagsasa | 2285 | VPusUfscucUfgGfCf ugucAfuGfucugcsus a | 2420 | UAGCAGACAUGA CAGCCAGAGAC | 2555 |
| AD-1416816 | usgsaca(Ghd)CfcAfGfAfg accugugscsa | 2286 | VPusGfscacAfgGfUf cucuGfgCfugucasusg | 2421 | CAUGACAGCCAG AGACCUGUGCC | 2556 |
| AD-1416823 | csasgag(Ahd)CfcUfGfUfg ccaauugscsa | 2287 | VPusGfscaaUfuGfGf cacaGfgUfcucugsgsc | 2422 | GCCAGAGACCUG UGCCAAUUGCU | 2557 |
| AD-1416830 | csusgug(Chd)CfaAfUfUf gcugguuusasa | 2288 | VPusUfsaaaCfcAfGf caauUfgGfcacagsgsu | 2423 | ACCUGUGCCAAU UGCUGGUUUAC | 2558 |
| AD-1416837 | asasuug(Chd)UfgGfUfUf uacaaaagsusa | 2289 | VPusAfscuuUfuGfU faaacCfaGfcaauusgs g | 2424 | CCAAUUGCUGGU UUACAAAAGUC | 2559 |
| AD-1416841 | gsgsaug(Ahd)CfaAfCfAf gcuggacascsa | 2290 | VPusGfsuguCfcAfG fcuguUfgUfcauccsas c | 2425 | GUGGAUGACAAC AGCUGGACACU | 2560 |
| AD-1416848 | asascag(Chd)UfgGfAfCfa cuaguggsasa | 2291 | VPusUfsccaCfuAfGf ugucCfaGfcuguusgs u | 2426 | ACAACAGCUGGA CACUAGUGGAG | 2561 |
| AD-1416855 | gsgsaca(Chd)UfaGfUfGfg agcaccascsa | 2292 | VPusGfsuggUfgCfU fccacUfaGfuguccsas g | 2427 | CUGGACACUAGU GGAGCACCACC | 2562 |
| AD-1416863 | gsusgga(Ghd)CfaCfCfAfc ccgcaccsusa | 2293 | VPusAfsgguGfcGfG fguggUfgCfuccacsus a | 2428 | UAGUGGAGCACC ACCCGCACCUA | 2563 |
| AD-1416870 | ascscac(Chd)CfgCfAfCfc uaggauusasa | 2294 | VPusUfsaauCfcUfAf ggugCfgGfguggusgs c | 2429 | GCACCACCCGCA CCUAGGAUUAG | 2564 |
| AD-1416893 | asgsgug(Chd)UfuGfGfAf agaccaugsasa | 2295 | VPusUfscauGfgUfCf uuccAfaGfcaccuscsu | 2430 | AGAGGUGCUUGG AAGACCAUGAG | 2565 |
| AD-1416900 | usgsgaa(Ghd)AfcCfAfUf gagcuggusgsa | 2296 | VPusCfsaccAfgCfUf caugGfuCfuuccasasg | 2431 | CUUGGAAGACCA UGAGCUGGUGG | 2566 |
| AD-1416907 | cscsaug(Ahd)GfcUfGfGf ugguccagsgsa | 2297 | VPusCfscugGfaCfCf accaGfcUfcauggsusc | 2432 | GACCAUGAGCUG GUGGUCCAGGU | 2567 |
| AD-1416914 | csusggu(Ghd)GfuCfCfAf gguggagasgsa | 2298 | VPusCfsucuCfcAfCf cuggAfcCfaccagscsu | 2433 | AGCUGGUGGUCC AGGUGGAGAGU | 2568 |
| AD-1416921 | uscscag(Ghd)UfgGfAfGf aguaccausgsa | 2299 | VPusCfsaugGfuAfCf ucucCfaCfcuggascsc | 2434 | GGUCCAGGUGGA GAGUACCAUGG | 2569 |

TABLE 6-continued

Human Modified Sense and Antisense Strand Sequences of GRB10 dsRNA Agents that use C16 Ligand

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1416928 | gsgsaga(Ghd)UfaCfCfAfu ggccagusgsa | 2300 | VPusCfsacuGfgCfCf auggUfaCfucuccsasc | 2435 | GUGGAGAGUACC AUGGCCAGUGA | 2570 |
| AD-1416935 | ascscau(Ghd)GfcCfAfGfu gagaguasasa | 2301 | VPusUfsuacUfcUfCf acugGfcCfauggusasc | 2436 | GUACCAUGGCCA GUGAGAGUAAA | 2571 |
| AD-1416942 | cscsagu(Ghd)AfgAfGfUf aaauuucusasa | 2302 | VPusUfsagaAfaUfUf uacuCfuCfacuggscsc | 2437 | GGCCAGUGAGAG UAAAUUUCUAU | 2572 |
| AD-1416949 | gsasgua(Ahd)AfuUfUfCf uauucaggsasa | 2303 | VPusUfsccuGfaAfUf agaaAfuUfuacucsusc | 2438 | GAGAGUAAAUU UCUAUUCAGGAA | 2573 |
| AD-1416957 | ususcua(Uhd)UfcAfGfGf aagaauuascsa | 2304 | VPusGfsuaaUfuCfUf uccuGfaAfuagaasasu | 2439 | AUUUCUAUUCAG GAAGAAUUACG | 2574 |
| AD-1416964 | csasgga(Ahd)GfaAfUfUfa cgcaaaasusa | 2305 | VPusAfsuuuUfgCfG fuaauUfcUfuccugsas a | 2440 | UUCAGGAAGAAU UACGCAAAAUA | 2575 |
| AD-1416971 | asasuua(Chd)GfcAfAfAfa uacgagususa | 2306 | VPusAfsacuCfgUfAf uuuuGfcGfuaauuscs u | 2441 | AGAAUUACGCAA AAUACGAGUUC | 2576 |
| AD-1416978 | csasaaa(Uhd)AfcGfAfGfu ucuuuaasasa | 2307 | VPusUfsuuaAfaGfA facucGfuAfuuuugscs g | 2442 | CGCAAAAUACGA GUUCUUUAAAA | 2577 |
| AD-1417009 | ususucu(Uhd)CfcCfAfGfa acagaugsgsa | 2308 | VPusCfscauCfuGfUf ucugGfgAfagaaasusu | 2443 | AAUUUCUUCCCA GAACAGAUGGU | 2578 |
| AD-1417016 | cscsaga(Ahd)CfaGfAfUfg guuacuusgsa | 2309 | VPusCfsaagUfaAfCf caucUfgUfucuggsgsa | 2444 | UCCCAGAACAGA UGGUUACUUGG | 2579 |
| AD-1417023 | asgsaug(Ghd)UfuAfCfUf uggugccasgsa | 2310 | VPusCfsuggCfaCfCf aaguAfaCfcaucusgsu | 2445 | ACAGAUGGUUAC UUGGUGCCAGC | 2580 |
| AD-1417030 | usascuu(Ghd)GfuGfCfCfa gcagucasasa | 2311 | VPusUfsugaCfuGfCf uggcAfcCfaaguasasc | 2446 | GUUACUUGGUGC CAGCAGUCAAA | 2581 |
| AD-1417037 | usgscca(Ghd)CfaGfUfCfa aauggcasgsa | 2312 | VPusCfsugcCfaUfUf ugacUfgCfuggcascsc | 2447 | GGUGCCAGCAGU CAAAUGGCAGU | 2582 |
| AD-1417044 | asgsuca(Ahd)AfuGfGfCfa gucaaacscsa | 2313 | VPusGfsguuUfgAfC fugccAfuUfugacusgs c | 2448 | GCAGUCAAAUGG CAGUCAAACCC | 2583 |
| AD-1417051 | usgsgca(Ghd)UfcAfAfAf cccagcuususa | 2314 | VPusAfsaagCfuGfGf guuuGfaCfugccasusu | 2449 | AAUGGCAGUCAA ACCCAGCUUUU | 2584 |
| AD-1417078 | ususuuc(Uhd)GfaAfCfUf ccaguagususa | 2315 | VPusAfsacuAfcUfGf gaguUfcAfgaaaasusu | 2450 | AAUUUUCUGAAC UCCAGUAGUUG | 2585 |
| AD-1417085 | asascuc(Chd)AfgUfAfGfu uguccugsasa | 2316 | VPusUfscagGfaCfAf acuaCfuGfgaguuscsa | 2451 | UGAACUCCAGUA GUUGUCCUGAA | 2586 |
| AD-1417092 | gsusagu(Uhd)GfuCfCfUf gaaauucasasa | 2317 | VPusUfsugaAfuUfU fcaggAfcAfacuacsus g | 2452 | CAGUAGUUGUCC UGAAAUUCAAG | 2587 |
| AD-1417118 | ususgca(Uhd)GfuGfAfAf agagcuggsgsa | 2318 | VPusCfsccaGfcUfCf uuucAfcAfugcaasasa | 2453 | UUUUGCAUGUGA AAGAGCUGGGA | 2588 |
| AD-1417125 | usgsaaa(Ghd)AfgCfUfGf ggaaagaasasa | 2319 | VPusUfsuucUfuUfC fccagCfuCfuuucascs a | 2454 | UGUGAAAGAGCU GGGAAAGAAAU | 2589 |
| AD-1417132 | gscsugg(Ghd)AfaAfGfAf aaucauggsasa | 2320 | VPusUfsccaUfgAfUf uucuUfuCfccagcsusc | 2455 | GAGCUGGGAAAG AAAUCAUGGAA | 2590 |
| AD-1417154 | asasgcu(Ghd)UfaUfGfUf guguuugcsgsa | 2321 | VPusCfsgcaAfaCfAf cacaUfaCfagcuususu | 2456 | AAAAGCUGUAUG UGUGUUUGCGG | 2591 |

TABLE 6-continued

Human Modified Sense and Antisense Strand Sequences of GRB10 dsRNA Agents that use C16 Ligand

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1417161 | asusgug(Uhd)GfuUfUfGf cggagaucsusa | 2322 | VPusAfsgauCfuCfCf gcaaAfcAfcacausasc | 2457 | GUAUGUGUGUU UGCGGAGAUCUG | 2592 |
| AD-1417168 | ususugc(Ghd)GfaGfAfUf cuggccuususa | 2323 | VPusAfsaagGfcCfAf gaucUfcCfgcaaascsa | 2458 | UGUUUGCGGAGA UCUGGCCUUUA | 2593 |
| AD-1417175 | asgsauc(Uhd)GfgCfCfUfu uauugcuscsa | 2324 | VPusGfsagcAfaUfAf aaggCfcAfgaucuscsc | 2459 | GGAGAUCUGGCC UUUAUUGCUCC | 2594 |
| AD-1417182 | gscscuu(Uhd)AfuUfGfCf uccaccaasgsa | 2325 | VPusCfsuugGfuGfG fagcaAfuAfaaggcscs a | 2460 | UGGCCUUUAUUG CUCCACCAAGG | 2595 |
| AD-1417189 | ususgcu(Chd)CfaCfCfAfa gggaacususa | 2326 | VPusAfsaguUfcCfCf uuggUfgGfagcaasusa | 2461 | UAUUGCUCCACC AAGGGAACUUC | 2596 |
| AD-1417233 | gscscga(Chd)CfuGfGfAfg gacagcasasa | 2327 | VPusUfsugcUfgUfC fcuccAfgGfucggcscs a | 2462 | UGGCCGACCUGG AGGACAGCAAC | 2597 |
| AD-1417240 | usgsgag(Ghd)AfcAfGfCf aacaucuuscsa | 2328 | VPusGfsaagAfuGfU fugcuGfuCfcuccasgs g | 2463 | CCUGGAGGACAG CAACAUCUUCU | 2598 |
| AD-1417247 | csasgca(Ahd)CfaUfCfUfu cucccugsasa | 2329 | VPusUfscagGfgAfG faagaUfgUfugcugsus c | 2464 | GACAGCAACAUC UUCUCCCUGAU | 2599 |
| AD-1417254 | asuscuu(Chd)UfcCfCfUfg aucgcugsgsa | 2330 | VPusCfscagCfgAfUf caggGfaGfaagausgsu | 2465 | ACAUCUUCUCCC UGAUCGCUGGC | 2600 |
| AD-1417261 | cscscug(Ahd)UfcGfCfUfg gcaggaasgsa | 2331 | VPusCfsuucCfuGfCf cagcGfaUfcagggsasg | 2466 | CUCCCUGAUCGC UGGCAGGAAGC | 2601 |
| AD-1417268 | csgscug(Ghd)CfaGfGfAfa gcaguacsasa | 2332 | VPusUfsguaCfuGfCf uuccUfgCfcagcgsasu | 2467 | AUCGCUGGCAGG AAGCAGUACAA | 2602 |
| AD-1417275 | usascag(Ahd)CfcAfCfGfg gcucugcsasa | 2333 | VPusUfsgcaGfaGfCf ccguGfgUfcuguasgs g | 2468 | CCUACAGACCAC GGGCUCUGCAU | 2603 |
| AD-1417302 | asasaca(Ahd)AfgUfCfAfg gaaugaasasa | 2334 | VPusUfsuucAfuUfC fcugaCfuUfuguuusgs g | 2469 | CCAAACAAAGUC AGGAAUGAAAC | 2604 |
| AD-1417309 | gsuscag(Ghd)AfaUfGfAf aacuaaagsasa | 2335 | VPusUfscuuUfaGfU fuucaUfuCfcugacsus u | 2470 | AAGUCAGGAAUG AAACUAAAGAG | 2605 |
| AD-1417316 | asusgaa(Ahd)CfuAfAfAf gagcugagsgsa | 2336 | VPusCfscucAfgCfUf cuuuAfgUfuucausus c | 2471 | GAAUGAAACUAA AGAGCUGAGGU | 2606 |
| AD-1417323 | usasaag(Ahd)GfcUfGfAf gguugcucsusa | 2337 | VPusAfsgagCfaAfCf cucaGfcUfcuuuasgsu | 2472 | ACUAAAGAGCUG AGGUUGCUCUG | 2607 |
| AD-1417330 | csusgag(Ghd)UfuGfCfUf cugugcagsasa | 2338 | VPusUfscugCfaCfAf gagcAfaCfcucagscsu | 2473 | AGCUGAGGUUGC UCUGUGCAGAG | 2608 |
| AD-1417337 | usgscuc(Uhd)GfuGfCfAf gaggacgasgsa | 2339 | VPusCfsucgUfcCfUf cugcAfcAfgagcasasc | 2474 | GUUGCUCUGUGC AGAGGACGAGC | 2609 |
| AD-1417344 | usgscag(Ahd)GfgAfCfGf agcaaaccsasa | 2340 | VPusUfsgguUfuGfC fucguCfcUfcugcascs a | 2475 | UGUGCAGAGGAC GAGCAAACCAG | 2610 |
| AD-1417351 | gsascga(Ghd)CfaAfAfCfc aggacgusgsa | 2341 | VPusCfsacgUfcCfUf gguuUfgCfucgucscs | 2476 | AGGACGAGCAAA CCAGGACGUGC | 2611 |

TABLE 6-continued

Human Modified Sense and Antisense Strand Sequences of GRB10 dsRNA Agents that use C16 Ligand

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1417358 | asasacc(Ahd)GfgAfCfGfu gcuggausgsa | 2342 | VPusCfsaucCfaGfCf acguCfcUfgguuusgsc | 2477 | GCAAACCAGGAC GUGCUGGAUGA | 2612 |
| AD-1417365 | gsascgu(Ghd)CfuGfGfAf ugacagcgsusa | 2343 | VPusAfscgcUfgUfCf auccAfgCfacgucscsu | 2478 | AGGACGUGCUGG AUGACAGCGUU | 2613 |
| AD-1417372 | usgsgau(Ghd)AfcAfGfCf guucagacsusa | 2344 | VPusAfsgucUfgAfA fcgcuGfuCfauccasgs c | 2479 | GCUGGAUGACAG CGUUCAGACUC | 2614 |
| AD-1417401 | usgsgaa(Uhd)GfcUfCfCfu uuaccagsasa | 2345 | VPusUfscugGfuAfA faggaGfcAfuuccasus a | 2480 | UAUGGAAUGCUC CUUUACCAGAA | 2615 |
| AD-1417408 | csusccu(Uhd)UfaCfCfAfg aauuaccsgsa | 2346 | VPusCfsgguAfaUfU fcuggUfaAfaggagscs a | 2481 | UGCUCCUUUACC AGAAUUACCGA | 2616 |
| AD-1417415 | ascscag(Ahd)AfuUfAfCfc gaaucccsusa | 2347 | VPusAfsgggAfuUfC fgguaAfuUfcuggusas a | 2482 | UUACCAGAAUUA CCGAAUCCCUC | 2617 |
| AD-1417422 | ususacc(Ghd)AfaUfCfCfc ucagcagsasa | 2348 | VPusUfscugCfuGfA fgggaUfuCfgguaasus | 2483 | AAUUACCGAAUC CCUCAGCAGAG | 2618 |
| AD-1417429 | susccc(Uhd)CfaGfCfAfg aggaaggscsa | 2349 | VPusGfsccuUfcCfUf cugcUfgAfgggausus c | 2484 | GAAUCCCUCAGC AGAGGAAGGCC | 2619 |
| AD-1417436 | asgscag(Ahd)GfgAfAfGf gccuugcusgsa | 2350 | VPusCfsagcAfaGfGf ccuuCfcUfcugcusgsa | 2485 | UCAGCAGAGGAA GGCCUUGCUGU | 2620 |
| AD-1417459 | csasgug(Uhd)CfuCfCfGfa gaacuccscsa | 2351 | VPusGfsggaGfuUfC fucggAfgAfcacugscs g | 2486 | CGCAGUGUCUCC GAGAACUCCCU | 2621 |
| AD-1417466 | uscscga(Ghd)AfaCfUfCfc cucguggscsa | 2352 | VPusGfsccaCfgAfGf ggagUfuCfucggasgsa | 2487 | UCUCCGAGAACU CCCUCGUGGCA | 2622 |
| AD-1417473 | ascsucc(Chd)UfcGfUfGfg caauggasusa | 2353 | VPusAfsuccAfuUfG fccacGfaGfggagusus c | 2488 | GAACUCCCUCGU GGCAAUGGAUU | 2623 |
| AD-1417495 | ususcug(Ghd)GfcAfAfAf caggacgcsgsa | 2354 | VPusCfsgcgUfcCfUf guuuGfcCfcagaasasa | 2489 | UUUUCUGGGCAA ACAGGACGCGU | 2624 |
| AD-1417502 | csasaac(Ahd)GfgAfCfGfc gugauagsasa | 2355 | VPusUfscuaUfcAfCf gcguCfcUfguuugscsc | 2490 | GGCAAACAGGAC GCGUGAUAGAG | 2625 |
| AD-1417509 | gsascgc(Ghd)UfgAfUfAf gagaauccsgsa | 2356 | VPusCfsggaUfuCfUf cuauCfaCfgcgucscsu | 2491 | AGGACGCGUGAU AGAGAAUCCGG | 2626 |
| AD-1417516 | gsasuag(Ahd)GfaAfUfCfc ggcagagsgsa | 2357 | VPusCfscucUfgCfCf ggauUfcUfcuaucsasc | 2492 | GUGAUAGAGAA UCCGGCAGAGGC | 2627 |
| AD-1417523 | asasucc(Ghd)GfcAfGfAfg gcccagasgsa | 2358 | VPusCfsucuGfgGfCf cucuGfcCfggauuscsu | 2493 | AGAAUCCGGCAG AGGCCCAGAGC | 2628 |
| AD-1417556 | gscsgaa(Ghd)CfaCfAfCfg gaugaacsasa | 2359 | VPusUfsguuCfaUfCf cgugUfgCfuucgcsus u | 2494 | AAGCGAAGCACA CGGAUGAACAU | 2629 |
| AD-1417563 | ascsacg(Ghd)AfuGfAfAfc auccuagsgsa | 2360 | VPusCfscuaGfgAfUf guucAfuCfcgugusgs c | 2495 | GCACACGGAUGA ACAUCCUAGGU | 2630 |
| AD-1417570 | usgsaac(Ahd)UfcCfUfAfg guagccasasa | 2361 | VPusUfsuggCfuAfC fcuagGfaUfguucasus c | 2496 | GAUGAACAUCCU AGGUAGCCAAA | 2631 |
| AD-1417576 | csuscca(Chd)CfcUfUfCfu acccuaasgsa | 2362 | VPusCfsuuaGfgGfU fagaaGfgGfuggagsgs g | 2497 | CCCUCCACCCUU CUACCCUAAGU | 2632 |

TABLE 6-continued

Human Modified Sense and Antisense Strand Sequences of GRB10 dsRNA Agents that use C16 Ligand

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1417603 | asusuca(Chd)AfgGfAfCfa cagcacusgsa | 2363 | VPusCfsaguGfcUfGf ugucCfuGfugaauscsa | 2498 | UGAUUCACAGGA CACAGCACUGG | 2633 |
| AD-1417610 | gsgsaca(Chd)AfgCfAfCfu gguuucascsa | 2364 | VPusGfsugaAfaCfCf agugCfuGfuguccsus g | 2499 | CAGGACACAGCA CUGGUUUCACG | 2634 |
| AD-1417617 | gscsacu(Ghd)GfuUfUfCfa cgggaggsasa | 2365 | VPusUfsccuCfcCfGf ugaaAfcCfagugcsusg | 2500 | CAGCACUGGUUU CACGGGAGGAU | 2635 |
| AD-1417624 | ususuca(Chd)GfgGfAfGf gaucuccasgsa | 2366 | VPusCfsuggAfgAfU fccucCfcGfugaaascs c | 2501 | GGUUUCACGGGA GGAUCUCCAGG | 2636 |
| AD-1417631 | gsgsagg(Ahd)UfcUfCfCfa gggaggasasa | 2367 | VPusUfsuccUfcCfCf uggaGfaUfccuccscsg | 2502 | CGGGAGGAUCUC CAGGGAGGAAU | 2637 |
| AD-1417638 | csuscca(Ghd)GfgAfGfGfa aucccacsasa | 2368 | VPusUfsgugGfgAfU fuccuCfcCfuggagsas u | 2503 | AUCUCCAGGGAG GAAUCCCACAG | 2638 |
| AD-1417645 | gsasgga(Ahd)UfcCfCfAfc aggaucasusa | 2369 | VPusAfsugaUfcCfUf guggGfaUfuccucscsc | 2504 | GGGAGGAAUCCC ACAGGAUCAUU | 2639 |
| AD-1417652 | cscscac(Ahd)GfgAfUfCfa uuaaacasgsa | 2370 | VPusCfsuguUfuAfA fugauCfcUfgugggsas u | 2505 | AUCCCACAGGAU CAUUAAACAGC | 2640 |
| AD-1417659 | gsasuca(Uhd)UfaAfAfCfa gcaagggscsa | 2371 | VPusGfscccUfuGfCf uguuUfaAfugaucscs | 2506 | AGGAUCAUUAAA CAGCAAGGGCU | 2641 |
| AD-1417666 | asasaca(Ghd)CfaAfGfGfg cucguggsasa | 2372 | VPusUfsccaCfgAfGf cccuUfgCfuguuusasa | 2507 | UUAAACAGCAAG GGCUCGUGGAU | 2642 |

TABLE 7

Human Unmodified Sense and Antisense Strand Sequences of GRB14 dsRNA Agents

| Duplex ID | Sense Sequence 5' to 3' | SEQ ID NO: | Range in NM_004490.3 | Antisense Sequence 5' to 3' | SEQ NO: | Range in NM 004490.3 |
|---|---|---|---|---|---|---|
| AD-1399762 | GCCGGCGACAA UGACCACUUU | 728 | 164-184 | AAAGUGGUCAUUG UCGCCGGCCG | 863 | 162-184 |
| AD-1399763 | UGACCACUUCCC UGCAAGAUU | 729 | 175-195 | AAUCUUGCAGGGA AGUGGUCAUU | 864 | 173-195 |
| AD-1399764 | GCUGUGCUGCA GACAGGAGAU | 730 | 349-369 | AUCUCCUGUCUGC AGCACAGCCG | 865 | 347-369 |
| AD-1399765 | AAGAAAGAUCU UGAUGUUCCU | 731 | 372-392 | AGGAACAUCAAGA UCUUUCUUUU | 866 | 370-392 |
| AD-1399766 | UGAUGUUCCGG AAAUGCCAUU | 732 | 383-403 | AAUGGCAUUUCCG GAACAUCAAG | 867 | 381-403 |
| AD-1399767 | AAAUGCCAUCU AUUCCAAACU | 733 | 394-414 | AGUUUGGAAUAGA UGGCAUUUCC | 868 | 392-414 |
| AD-1399768 | AUUCCAAACCC UUUUCCUGAU | 734 | 405-425 | AUCAGGAAAAGGG UUUGGAAUAG | 869 | 403-425 |
| AD-1399769 | UUUUCCUGAGC UAUGCUGUUU | 735 | 416-436 | AAACAGCAUAGCU CAGGAAAAGG | 870 | 414-436 |
| AD-1399770 | UAUGCUGUUCU CCAUUUACAU | 736 | 427-447 | AUGUAAAUGGAGA ACAGCAUAGC | 871 | 425-447 |

TABLE 7-continued

Human Unmodified Sense and Antisense Strand Sequences of GRB14 dsRNA Agents

| Duplex ID | Sense Sequence 5' to 3' | SEQ ID NO: | Range in NM_004490.3 | Antisense Sequence 5' to 3' | SEQ NO: | Range in NM 004490.3 |
|---|---|---|---|---|---|---|
| AD-1399771 | CCAUUUACAUCUGUGUUGUCU | 737 | 438-458 | AGACAACACAGAUGUAAAUGGAG | 872 | 436-458 |
| AD-1399772 | UGUGUUGUCAGCAGACCUAUU | 738 | 449-469 | AAUAGGUCUGCUGACAACACAGA | 873 | 447-469 |
| AD-1399773 | CAGACCUAUUUCCCAAAGCAU | 739 | 460-480 | AUGCUUUGGGAAAUAGGUCUGCU | 874 | 458-480 |
| AD-1399774 | CCCAAAGCAAAUUCAAGGAAU | 740 | 471-491 | AUUCCUUGAAUUUGCUUUGGGAA | 875 | 469-491 |
| AD-1399775 | AACAGGUGAUUAAAGUAUACU | 741 | 493-513 | AGUAUACUUUAAUCACCUGUUUU | 876 | 491-513 |
| AD-1399776 | AAAGUAUACAGUGAAGAUGAU | 742 | 504-524 | AUCAUCUUCACUGUAUACUUUAA | 877 | 502-524 |
| AD-1399777 | UGAAGAUGAAACCAGCAGGGU | 743 | 515-535 | ACCCUGCUGGUUUCAUCUUCACU | 878 | 513-535 |
| AD-1399778 | CCAGCAGGGCUUUAGAUGUAU | 744 | 526-546 | AUACAUCUAAAGCCCUGCUGGUU | 879 | 524-546 |
| AD-1399779 | UUAGAUGUACCCAGUGACAUU | 745 | 537-557 | AAUGUCACUGGGUACAUCUAAAG | 880 | 535-557 |
| AD-1399780 | CAGUGACAUAACGGCUCGAGU | 746 | 548-568 | ACUCGAGCCGUUAUGUCACUGGG | 881 | 546-568 |
| AD-1399781 | CGGCUCGAGAUGUUUGUCAGU | 747 | 559-579 | ACUGACAAACAUCUCGAGCCGUU | 882 | 557-579 |
| AD-1399782 | GUUUGUCAGCUGUUGAUCCUU | 748 | 570-590 | AAGGAUCAACAGCUGACAAACAU | 883 | 568-590 |
| AD-1399783 | GUUGAUCCUGAAGAAUCAUUU | 749 | 581-601 | AAAUGAUUCUUCAGGAUCAACAG | 884 | 579-601 |
| AD-1399784 | AGAAUCAUUACAUUGAUGACU | 750 | 592-612 | AGUCAUCAAUGUAAUGAUUCUUC | 885 | 590-612 |
| AD-1399785 | AUUGAUGACCACAGCUGGACU | 751 | 603-623 | AGUCCAGCUGUGGUCAUCAAUGU | 886 | 601-623 |
| AD-1399786 | CAGCUGGACCCUUUUUGAGCU | 752 | 614-634 | AGCUCAAAAAGGGUCCAGCUGUG | 887 | 612-634 |
| AD-1399787 | UUUUUGAGCACCUGCCUCACU | 753 | 625-645 | AGUGAGGCAGGUGCUCAAAAAGG | 888 | 623-645 |
| AD-1399788 | CUGCCUCACAUAGGUGUAGAU | 754 | 636-656 | AUCUACACCUAUGUGAGGCAGGU | 889 | 634-656 |
| AD-1399789 | AGGUGUAGAAAGAACAAUAGU | 755 | 647-667 | ACUAUUGUUCUUUCUACACCUAU | 890 | 645-667 |
| AD-1399790 | GAACAAUAGAAGACCACGAAU | 756 | 658-678 | AUUCGUGGUCUUCUAUUGUUCUU | 891 | 656-678 |
| AD-1399791 | GACCACGAACUGGUGAUUGAU | 757 | 669-689 | AUCAAUCACCAGUUCGUGGUCUU | 892 | 667-689 |
| AD-1399792 | GGUGAUUGAAGUGCUAUCCAU | 758 | 680-700 | AUGGAUAGCACUUCAAUCACCAG | 893 | 678-700 |
| AD-1399793 | GAUAGAAGAAGAAAACAAACU | 759 | 707-727 | AGUUUGUUUUCUUCUUCUAUCCC | 894 | 705-727 |
| AD-1399794 | AUUAUGCCAAAUAUGAGUUCU | 760 | 742-762 | AGAACUCAUAUUUGGCAUAAUUU | 895 | 740-762 |
| AD-1399795 | AACCCAAUGUAUUUUUUUCCU | 761 | 768-788 | AGGAAAAAAAUACAUUGGGUUUU | 896 | 766-788 |

TABLE 7-continued

Human Unmodified Sense and Antisense Strand Sequences of GRB14 dsRNA Agents

| Duplex ID | Sense Sequence 5' to 3' | SEQ ID NO: | Range in NM_004490.3 | Antisense Sequence 5' to 3' | SEQ NO: | Range in NM 004490.3 |
|---|---|---|---|---|---|---|
| AD-1399796 | UUUUUUUCCAGAGCAUAUGGU | 762 | 779-799 | ACCAUAUGCUCUGGAAAAAAAUA | 897 | 777-799 |
| AD-1399797 | AGCAUAUGGUAUCUUUUGCAU | 763 | 790-810 | AUGCAAAAGAUACCAUAUGCUCU | 898 | 788-810 |
| AD-1399798 | UCUUUUGCAACUGAAACCAAU | 764 | 801-821 | AUUGGUUUCAGUUGCAAAAGAUA | 899 | 799-821 |
| AD-1399799 | UGAAACCAAUGGUGAAAUAUU | 765 | 812-832 | AAUAUUUCACCAUUGGUUUCAGU | 900 | 810-832 |
| AD-1399800 | CACACAGAUUUUGCAGAUGUU | 766 | 836-856 | AACAUCUGCAAAAUCUGUGUGGG | 901 | 834-856 |
| AD-1399801 | UGCAGAUGUUUCUGAGUUCAU | 767 | 847-867 | AUGAACUCAGAAACAUCUGCAAA | 902 | 845-867 |
| AD-1399802 | CUGAGUUCAAGCACAUAUCCU | 768 | 858-878 | AGGAUAUGUGCUUGAACUCAGAA | 903 | 856-878 |
| AD-1399803 | CACAUAUCCUGAAAUUCAUGU | 769 | 869-889 | ACAUGAAUUUCAGGAUAUGUGCU | 904 | 867-889 |
| AD-1399804 | AAAUUCAUGGUUUCUUACAUU | 770 | 880-900 | AAUGUAAGAAACCAUGAAUUUCA | 905 | 878-900 |
| AD-1399805 | UUCUUACAUGCGAAAGAACAU | 771 | 891-911 | AUGUUCUUUCGCAUGUAAGAAAC | 906 | 889-911 |
| AD-1399806 | GAAAGAACAGGGAAAGAAGUU | 772 | 902-922 | AACUUCUUUCCCUGUUCUUUCGC | 907 | 900-922 |
| AD-1399807 | CUUUUUUCUAAGAAGAUCUGU | 773 | 938-958 | ACAGAUCUUCUUAGAAAAAAGUA | 908 | 936-958 |
| AD-1399808 | AGAUCUGGUUUAUAUUUUUCU | 774 | 951-971 | AGAAAAAUAUAAACCAGAUCUUC | 909 | 949-971 |
| AD-1399809 | UUUUCUACUAAAGGAACAUCU | 775 | 966-986 | AGAUGUUCCUUUAGUAGAAAAAU | 910 | 964-986 |
| AD-1399810 | AGGAACAUCAAAGGAACCGCU | 776 | 977-997 | AGCGGUUCCUUUGAUGUUCCUUU | 911 | 975-997 |
| AD-1399811 | AGGAACCGCGGCAUUUGCAGU | 777 | 988-1008 | ACUGCAAAUGCCGCGGUUCCUUU | 912 | 986-1008 |
| AD-1399812 | CAUUUGCAGUUUUUCAGCGAU | 778 | 999-1019 | AUCGCUGAAAAACUGCAAAUGCC | 913 | 997-1019 |
| AD-1399813 | UUUCAGCGAAUUUGGCAAUAU | 779 | 1010-1030 | AUAUUGCCAAAUUCGCUGAAAAA | 914 | 1008-1030 |
| AD-1399814 | UGGCAAUAGUGAUAUUUAUGU | 780 | 1022-1042 | ACAUAAAUAUCACUAUUGCCAAA | 915 | 1020-1042 |
| AD-1399815 | AUAUUUAUGUGUCACUGGCAU | 781 | 1033-1053 | AUGCCAGUGACACAUAAAUAUCA | 916 | 1031-1053 |
| AD-1399816 | AACAUGGAGCACCGACUAACU | 782 | 1063-1083 | AGUUAGUCGGUGCUCCAUGUUUU | 917 | 1061-1083 |
| AD-1399817 | CCGACUAACUAUGGAUUCUGU | 783 | 1074-1094 | ACAGAAUCCAUAGUUAGUCGGUG | 918 | 1072-1094 |
| AD-1399818 | UGGAUUCUGCUUUAAGCCUAU | 784 | 1085-1105 | AUAGGCUUAAAGCAGAAUCCAUA | 919 | 1083-1105 |

TABLE 7-continued

Human Unmodified Sense and Antisense Strand Sequences of GRB14 dsRNA Agents

| Duplex ID | Sense Sequence 5' to 3' | SEQ ID NO: | Range in NM_004490.3 | Antisense Sequence 5' to 3' | SEQ NO: | Range in NM 004490.3 |
|---|---|---|---|---|---|---|
| AD-1399819 | UUAAGCCUAACAAAGCGGGAU | 785 | 1096-1116 | AUCCCGCUUUGUUAGGCUUAAAG | 920 | 1094-1116 |
| AD-1399820 | CGAGACCUGAAAAUGCUCUGU | 786 | 1122-1142 | ACAGAGCAUUUUCAGGUCUCGGG | 921 | 1120-1142 |
| AD-1399821 | AAUGCUCUGUGCAGAAGAAGU | 787 | 1133-1153 | ACUUCUUCUGCACAGAGCAUUUU | 922 | 1131-1153 |
| AD-1399822 | CAGAAGAAGAGCAGAGUAGGU | 788 | 1144-1164 | ACCUACUCUGCUCUUCUUCUGCA | 923 | 1142-1164 |
| AD-1399823 | CAGAGUAGGACGUGCUGGGUU | 789 | 1155-1175 | AACCCAGCACGUCCUACUCUGCU | 924 | 1153-1175 |
| AD-1399824 | GUGCUGGGUGACCGCGAUUAU | 790 | 1166-1186 | AUAAUCGCGGUCACCCAGCACGU | 925 | 1164-1186 |
| AD-1399825 | CCGCGAUUAGAUUGCUUAAGU | 791 | 1177-1197 | ACUUAAGCAAUCUAAUCGCGGUC | 926 | 1175-1197 |
| AD-1399826 | UUGCUUAAGUAUGGCAUGCAU | 792 | 1188-1208 | AUGCAUGCCAUACUUAAGCAAUC | 927 | 1186-1208 |
| AD-1399827 | UGGCAUGCAGCUGUACCAGAU | 793 | 1199-1219 | AUCUGGUACAGCUGCAUGCCAUA | 928 | 1197-1219 |
| AD-1399828 | UGUACCAGAAUUAUAUGCAUU | 794 | 1210-1230 | AAUGCAUAUAAUUCUGGUACAGC | 929 | 1208-1230 |
| AD-1399829 | UAUAUGCAUCCAUAUCAAGGU | 795 | 1221-1241 | ACCUUGAUAUGGAUGCAUAUAAU | 930 | 1219-1241 |
| AD-1399830 | AUAUCAAGGUAGAAGUGGCUU | 796 | 1232-1252 | AAGCCACUUCUACCUUGAUAUGG | 931 | 1230-1252 |
| AD-1399831 | GAAGUGGCUGCAGUUCACAGU | 797 | 1243-1263 | ACUGUGAACUGCAGCCACUUCUA | 932 | 1241-1263 |
| AD-1399832 | AGUUCACAGAGCAUAUCACCU | 798 | 1254-1274 | AGGUGAUAUGCUCUGUGAACUGC | 933 | 1252-1274 |
| AD-1399833 | CAUAUCACCUAUGAGAAGUAU | 799 | 1265-1285 | AUACUUCUCAUAGGUGAUAUGCU | 934 | 1263-1285 |
| AD-1399834 | UGAGAAGUAUAUCAGAGAAUU | 800 | 1276-1296 | AAUUCUCUGAUAUACUUCUCAUA | 935 | 1274-1296 |
| AD-1399835 | UCAGAGAAUUCCCUGGUAGCU | 801 | 1287-1307 | AGCUACCAGGGAAUUCUCUGAUA | 936 | 1285-1307 |
| AD-1399836 | CCUGGUAGCAAUGGACUUCUU | 802 | 1298-1318 | AAGAAGUCCAUUGCUACCAGGGA | 937 | 1296-1318 |
| AD-1399837 | UGGACUUCUCAGGCCAGAAAU | 803 | 1309-1329 | AUUUCUGGCCUGAGAAGUCCAUU | 938 | 1307-1329 |
| AD-1399838 | GGCCAGAAAAGCAGAGUUAUU | 804 | 1320-1340 | AAUAACUCUGCUUUUCUGGCCUG | 939 | 1318-1340 |
| AD-1399839 | CAGAGUUAUAGAAAAUCCCAU | 805 | 1331-1351 | AUGGGAUUUUCUAUAACUCUGCU | 940 | 1329-1351 |
| AD-1399840 | AAAAUCCCACUGAAGCCCUUU | 806 | 1342-1362 | AAAGGGCUUCAGUGGGAUUUUCU | 941 | 1340-1362 |
| AD-1399841 | GAAGCCCUUUCAGUUGCGGUU | 807 | 1353-1373 | AACCGCAACUGAAAGGGCUUCAG | 942 | 1351-1373 |
| AD-1399842 | AGUUGCGGUUGAAGAAGGACU | 808 | 1364-1384 | AGUCCUUCUUCAACCGCAACUGA | 943 | 1362-1384 |
| AD-1399843 | AAGAAGGACUCGCUUGGAGGU | 809 | 1375-1395 | ACCUCCAAGCGAGUCCUUCUUCA | 944 | 1373-1395 |

TABLE 7-continued

Human Unmodified Sense and Antisense Strand Sequences of GRB14 dsRNA Agents

| Duplex ID | Sense Sequence 5' to 3' | SEQ ID NO: | Range in NM_004490.3 | Antisense Sequence 5' to 3' | SEQ NO: | Range in NM 004490.3 |
|---|---|---|---|---|---|---|
| AD-1399844 | AAGGAUGUUUACGCCUGGGCU | 810 | 1399-1419 | AGCCCAGGCGUAAACAUCCUUUU | 945 | 1397-1419 |
| AD-1399845 | CGCCUGGGCACUCACGGUAGU | 811 | 1410-1430 | ACUACCGUGAGUGCCCAGGCGUA | 946 | 1408-1430 |
| AD-1399846 | CACUGCCUCUUCACAGAGCUU | 812 | 1433-1453 | AAGCUCUGUGAAGAGGCAGUGGG | 947 | 1431-1453 |
| AD-1399847 | CACAGAGCUCUGCCACAAACU | 813 | 1444-1464 | AGUUUGUGGCAGAGCUCUGUGAA | 948 | 1442-1464 |
| AD-1399848 | GCCACAAACAUGGCUAUCCAU | 814 | 1455-1475 | AUGGAUAGCCAUGUUUGUGGCAG | 949 | 1453-1475 |
| AD-1399849 | GGCUAUCCACCGGUCCCAGCU | 815 | 1466-1486 | AGCUGGGACCGGUGGAUAGCCAU | 950 | 1464-1486 |
| AD-1399850 | GGUCCCAGCCAUGGUUUCACU | 816 | 1477-1497 | AGUGAAACCAUGGCUGGGACCGG | 951 | 1475-1497 |
| AD-1399851 | UGGUUUCACCACAAAAUUUCU | 817 | 1488-1508 | AGAAAUUUUGUGGUGAAACCAUG | 952 | 1486-1508 |
| AD-1399852 | CAAAAUUUCUAGAGAUGAGGU | 818 | 1499-1519 | ACCUCAUCUCUAGAAAUUUUGUG | 953 | 1497-1519 |
| AD-1399853 | GAGAUGAGGCUCAGCGAUUGU | 819 | 1510-1530 | ACAAUCGCUGAGCCUCAUCUCUA | 954 | 1508-1530 |
| AD-1399854 | CAGCGAUUGAUUAUUCAGCAU | 820 | 1521-1541 | AUGCUGAAUAAUCAAUCGCUGAG | 955 | 1519-1541 |
| AD-1399855 | UAUUCAGCAAGGACUUGUGGU | 821 | 1532-1552 | ACCACAAGUCCUUGCUGAAUAAU | 956 | 1530-1552 |
| AD-1399856 | GACUUGUGGAUGGAGUUUUCU | 822 | 1543-1563 | AGAAAACUCCAUCCACAAGUCCU | 957 | 1541-1563 |
| AD-1399857 | GGAGUUUUCUUGGUACGGGAU | 823 | 1554-1574 | AUCCCGUACCAAGAAAACUCCAU | 958 | 1552-1574 |
| AD-1399858 | GGUACGGGAUAGUCAGAGUAU | 824 | 1565-1585 | AUACUCUGACUAUCCCGUACCAA | 959 | 1563-1585 |
| AD-1399859 | CAAAACUUUCGUACUGUCAAU | 825 | 1589-1609 | AUUGACAGUACGAAAGUUUUGGG | 960 | 1587-1609 |
| AD-1399860 | UACUGUCAAUGAGUCAUGGAU | 826 | 1600-1620 | AUCCAUGACUCAUUGACAGUACG | 961 | 1598-1620 |
| AD-1399861 | AAGCACUUUCAAAUUAUACCU | 827 | 1629-1649 | AGGUAUAAUUUGAAAGUGCUUUA | 962 | 1627-1649 |
| AD-1399862 | AAUUAUACCAGUAGAAGAUGU | 828 | 1640-1660 | ACAUCUUCUACUGGUAUAAUUUG | 963 | 1638-1660 |
| AD-1399863 | UAGAAGAUGACGGUGAAAUGU | 829 | 1651-1671 | ACAUUUCACCGUCAUCUUCUACU | 964 | 1649-1671 |
| AD-1399864 | GGUGAAAUGUUCCACACACUU | 830 | 1662-1682 | AAGUGUGUGGAACAUUUCACCGU | 965 | 1660-1682 |
| AD-1399865 | CCACACACUGGAUGAUGGCCU | 831 | 1673-1693 | AGGCCAUCAUCCAGUGUGUGGAA | 966 | 1671-1693 |
| AD-1399866 | AUGAUGGCCACACAAGAUUUU | 832 | 1684-1704 | AAAAUCUUGUGUGGCCAUCAUCC | 967 | 1682-1704 |

TABLE 7-continued

Human Unmodified Sense and Antisense Strand Sequences of GRB14 dsRNA Agents

| Duplex ID | Sense Sequence 5' to 3' | SEQ ID NO: | Range in NM_004490.3 | Antisense Sequence 5' to 3' | SEQ NO: | Range in NM 004490.3 |
|---|---|---|---|---|---|---|
| AD-1399867 | ACAAGAUUUACAGAUCUAAUU | 833 | 1695-1715 | AAUUAGAUCUGUAAAUCUUGUGU | 968 | 1693-1715 |
| AD-1399868 | AGAUCUAAUACAGCUGGUGGU | 834 | 1706-1726 | ACCACCAGCUGUAUUAGAUCUGU | 969 | 1704-1726 |
| AD-1399869 | AGCUGGUGGAGUUCUAUCAAU | 835 | 1717-1737 | AUUGAUAGAACUCCACCAGCUGU | 970 | 1715-1737 |
| AD-1399870 | UUCUAUCAACUCAAUAAGGGU | 836 | 1728-1748 | ACCCUUAUUGAGUUGAUAGAACU | 971 | 1726-1748 |
| AD-1399871 | CAAUAAGGGCGUUCUUCCUUU | 837 | 1739-1759 | AAAGGAAGAACGCCCUUAUUGAG | 972 | 1737-1759 |
| AD-1399872 | UUCUUCCUUGCAAGUUGAAAU | 838 | 1750-1770 | AUUUCAACUUGCAAGGAAGAACG | 973 | 1748-1770 |
| AD-1399873 | AAGUUGAAACAUUAUUGUGCU | 839 | 1761-1781 | AGCACAAUAAUGUUUCAACUUGC | 974 | 1759-1781 |
| AD-1399874 | UUAUUGUGCUAGGAUUGCUCU | 840 | 1772-1792 | AGAGCAAUCCUAGCACAAUAAUG | 975 | 1770-1792 |
| LAD-1399875 | GGAUUGCUCUCUAGACAAGCU | 841 | 1783-1803 | AGCUUGUCUAGAGAGCAAUCCUA | 976 | 1781-1803 |
| AD-1399876 | UAGACAAGCCAGAAGUGACUU | 842 | 1794-1814 | AAGUCACUUCUGGCUUGUCUAGA | 977 | 1792-1814 |
| AD-1399877 | GAAGUGACUUAUUAAACUAUU | 843 | 1805-1825 | AAUAGUUUAAUAAGUCACUUCUG | 978 | 1803-1825 |
| AD-1399878 | UAAACUAUUGAAGGAAAAGGU | 844 | 1817-1837 | ACCUUUUCCUUCAAUAGUUUAAU | 979 | 1815-1837 |
| AD-1399879 | UAAAAGACCAUAAAUAAGGGU | 845 | 1852-1872 | ACCCUUAUUUAUGGUCUUUUAUU | 980 | 1850-1872 |
| AD-1399880 | AAAUAAGGGCGAAAACAUUAU | 846 | 1863-1883 | AUAAUGUUUUCGCCCUUAUUUAU | 981 | 1861-1883 |
| AD-1399881 | AAAACAUUACCAUGUGAAAAU | 847 | 1874-1894 | AUUUUCACAUGGUAAUGUUUUCG | 982 | 1872-1894 |
| AD-1399882 | AUGUGAAAAGAAUGUAUUUCU | 848 | 1885-1905 | AGAAAUACAUUCUUUUCACAUGG | 983 | 1883-1905 |
| AD-1399883 | AUGUAUUUCACCUGCAAGUUU | 849 | 1896-1916 | AAACUUGCAGGUGAAAUACAUUC | 984 | 1894-1916 |
| AD-1399884 | AAUAGUUUGUGCAUUGCAAAU | 850 | 1923-1943 | AUUUGCAAUGCACAAACUAUUUU | 985 | 1921-1943 |
| AD-1399885 | CAUUGCAAAUAAGCAAAGACU | 851 | 1934-1954 | AGUCUUUGCUUAUUUGCAAUGCA | 986 | 1932-1954 |
| AD-1399886 | AGCAAAGACUUGGAUUGACUU | 852 | 1945-1965 | AAGUCAAUCCAAGUCUUUGCUUA | 987 | 1943-1965 |
| AD-1399887 | GGAUUGACUUUACAUUCAUCU | 853 | 1956-1976 | AGAUGAAUGUAAAGUCAAUCCAA | 988 | 1954-1976 |
| AD-1399888 | AAUGACUUGGUGUGUUCUUGU | 854 | 2015-2035 | ACAAGAACACACCAAGUCAUUUU | 989 | 2013-2035 |
| AD-1399889 | GUGUUCUUGUGUGAUUUUUAU | 855 | 2026-2046 | AUAAAAAUCACACAAGAACACAC | 990 | 2024-2046 |
| AD-1399890 | GCAUAUUUAAAACAUGUCUCU | 856 | 2073-2093 | AGAGACAUGUUUUAAAUAUGCAU | 991 | 2071-2093 |
| AD-1399891 | ACAUGUCUCCCUUAUUUACCU | 857 | 2084-2104 | AGGUAAAUAAGGGAGACAUGUUU | 992 | 2082-2104 |

TABLE 7-continued

Human Unmodified Sense and Antisense Strand Sequences of GRB14 dsRNA Agents

| Duplex ID | Sense Sequence 5' to 3' | SEQ ID NO: | Range in NM_004490.3 | Antisense Sequence 5' to 3' | SEQ NO: | Range in NM 004490.3 |
|---|---|---|---|---|---|---|
| AD-1399892 | UUAUUUACCAUAUAGCAACAU | 858 | 2095-2115 | AUGUUGCUAUAUGGUAAAUAAGG | 993 | 2093-2115 |
| AD-1399893 | AUAGCAACAUCAGAAUUCUGU | 859 | 2106-2126 | ACAGAAUUCUGAUGUUGCUAUAU | 994 | 2104-2126 |
| AD-1399894 | AGAAUUCUGAAACACAAAAUU | 860 | 2117-2137 | AAUUUUGUGUUUCAGAAUUCUGA | 995 | 2115-2137 |
| AD-1399895 | UAUGAAAUAAAUUGGGAGUCU | 861 | 2136-2156 | AGACUCCCAAUUUAUUUCAUAUU | 996 | 2134-2156 |
| AD-1399896 | UUGGGAGUCAGGAAUAAUUAU | 862 | 2147-2167 | AUAAUUAUUCCUGACUCCCAAUU | 997 | 2145-2167 |

TABLE 8

Additional Human Unmodified Sense and Antisense Strand Sequences of GRB14 dsRNA Agents

| Duplex ID | Sense Sequence 5' to 3' | SEQ ID NO: | Range in NM_004490.3 | Antisense Sequence 5' to 3' | SEQ ID NO: | Range in NM_004490.3 |
|---|---|---|---|---|---|---|
| AD-1589130 | GUGAUUAAAGUAUACAGUGAU | 1403 | 498-518 | AUCACUGUAUACUUUAAUCACCU | 1516 | 496-518 |
| AD-1589133 | AUUAAAGUAUACAGUGAAGAU | 1404 | 501-521 | AUCUUCACUGUAUACUUUAAUCA | 1517 | 499-521 |
| AD-1589138 | GUAUACAGUGAAGAUGAAACU | 1405 | 507-527 | AGUUUCAUCUUCACUGUAUACUU | 1518 | 505-527 |
| AD-1589141 | UACAGUGAAGAUGAAACCAGU | 1406 | 510-530 | ACUGGUUUCAUCUUCACUGUAUA | 1519 | 508-530 |
| AD-1589260 | UCACAUAGGUGUAGAAAGAAU | 1407 | 641-661 | AUUCUUUCUACACCUAUGUGAGG | 1520 | 639-661 |
| AD-1589263 | CAUAGGUGUAGAAAGAACAAU | 1408 | 644-664 | AUUGUUCUUUCUACACCUAUGUG | 1521 | 642-664 |
| AD-1589268 | UGUAGAAAGAACAAUAGAAGU | 1409 | 650-670 | ACUUCUAUUGUUCUUUCUACACC | 1522 | 648-670 |
| AD-1589270 | AGAAAGAACAAUAGAAGACCU | 1410 | 653-673 | AGGUCUUCUAUUGUUCUUUCUAC | 1523 | 651-673 |
| AD-1589289 | CGAACUGGUGAUUGAAGUGCU | 1411 | 674-694 | AGCACUUCAAUCACCAGUUCGUG | 1524 | 672-694 |
| AD-1589292 | ACUGGUGAUUGAAGUGCUAUU | 1412 | 677-697 | AAUAGCACUUCAAUCACCAGUUC | 1525 | 675-697 |
| AD-1589297 | GAUUGAAGUGCUAUCCAACUU | 1413 | 683-703 | AAGUUGGAUAGCACUUCAAUCAC | 1526 | 681-703 |
| AD-1589302 | AGAAGAAGAAAACAAACUAU | 1414 | 710-730 | AAUAGUUUGUUUUCUUCUUC | 1527 | 708-730 |

TABLE 8-continued

Additional Human Unmodified Sense and Antisense Strand Sequences of GRB14 dsRNA Agents

| Duplex ID | Sense Sequence 5' to 3' | SEQ ID NO: | Range in NM_ 004490.3 | Antisense Sequence 5' to 3' | SEQ ID NO: | Range in NM_ 004490.3 |
|---|---|---|---|---|---|---|
| | U | | | UAU | | |
| AD-1589305 | AGAAGAAAACAAACUAUACUU | 1415 | 713-733 | AAGUAUAGUUUGUUUUCUUCUUC | 1528 | 711-733 |
| AD-1589316 | AUGCCAAAUAUGAGUUCUUUU | 1416 | 745-765 | AAAAGAACUCAUAUUUGGCAUAA | 1529 | 743-765 |
| AD-1589330 | UUUAAAAACCCAAUGUAUUUU | 1417 | 762-782 | AAAAUACAUUGGGUUUUUAAAGA | 1530 | 760-782 |
| AD-1589333 | UUCCAGAGCAUAUGGUAUCUU | 1418 | 784-804 | AAGAUACCAUAUGCUCUGGAAAA | 1531 | 782-804 |
| AD-1589336 | CAGAGCAUAUGGUAUCUUUUU | 1419 | 787-807 | AAAAAGAUACCAUAUGCUCUGGA | 1532 | 785-807 |
| AD-1589341 | AUAUGGUAUCUUUUGCAACUU | 1420 | 793-813 | AAGUUGCAAAAGAUACCAUAUGC | 1533 | 791-813 |
| AD-1589343 | AUGGUAUCUUUUGCAACUGAU | 1421 | 795-815 | AUCAGUUGCAAAAGAUACCAUAU | 1534 | 793-815 |
| AD-1589344 | UGGUAUCUUUUGCAACUGAAU | 1422 | 796-816 | AUUCAGUUGCAAAAGAUACCAUA | 1535 | 794-816 |
| AD-1589346 | GUAUCUUUUGCAACUGAAACU | 1423 | 798-818 | AGUUUCAGUUGCAAAAGAUACCA | 1536 | 796-818 |
| AD-1589351 | UUUGCAACUGAAACCAAUGGU | 1424 | 804-824 | ACCAUUGGUUUCAGUUGCAAAAG | 1537 | 802-824 |
| AD-1589354 | GCAACUGAAACCAAUGGUGAU | 1425 | 807-827 | AUCACCAUUGGUUUCAGUUGCAA | 1538 | 805-827 |
| AD-1589365 | AGAUUUUGCAGAUGUUUCUGU | 1426 | 841-861 | ACAGAAACAUCUGCAAAAUCUGU | 1539 | 839-861 |
| AD-1589368 | UUUUGCAGAUGUUUCUGAGUU | 1427 | 844-864 | AACUCAGAAACAUCUGCAAAAUC | 1540 | 842-864 |
| AD-1589373 | AGAUGUUUCUGAGUUCAAGCU | 1428 | 850-870 | AGCUUGAACUCAGAAACAUCUGC | 1541 | 848-870 |
| AD-1589376 | UGUUUCUGAGUUCAAGCACAU | 1429 | 853-873 | AUGUGCUUGAACUCAGAAACAUC | 1542 | 851-873 |
| AD-1589385 | UUCAAGCACAUAUCCUGAAAU | 1430 | 863-883 | AUUUCAGGAUAUGUGCUUGAACU | 1543 | 861-883 |
| AD-1589388 | AAGCACAUAUCCUGAAAUUCU | 1431 | 866-886 | AGAAUUUCAGGAUAUGUGCUUGA | 1544 | 864-886 |
| AD-1589393 | AUAUCCUGAAAUUCAUGGUUU | 1432 | 872-892 | AAACCAUGAAUUUCAGGAUAUGU | 1545 | 870-892 |

TABLE 8-continued

Additional Human Unmodified Sense and Antisense Strand Sequences of GRB14 dsRNA Agents

| Duplex ID | Sense Sequence 5' to 3' | SEQ ID NO: | Range in NM_ 004490.3 | Antisense Sequence 5' to 3' | SEQ ID NO: | Range in NM_ 004490.3 |
|---|---|---|---|---|---|---|
| AD-1589395 | AUCCUGAAAUUCAUGGUUUCU | 1433 | 874-894 | AGAAACCAUGAAUUUCAGGAUAU | 1546 | 872-894 |
| AD-1589396 | UCCUGAAAUUCAUGGUUUCUU | 1434 | 875-895 | AAGAAACCAUGAAUUUCAGGAUA | 1547 | 873-895 |
| AD-1589398 | CUGAAAUUCAUGGUUUCUUAU | 1435 | 877-897 | AUAAGAAACCAUGAAUUUCAGGA | 1548 | 875-897 |
| AD-1589403 | UUCAUGGUUUCUUACAUGCGU | 1436 | 883-903 | ACGCAUGUAAGAAACCAUGAAUU | 1549 | 881-903 |
| AD-1589406 | AUGGUUUCUUACAUGCGAAAU | 1437 | 886-906 | AUUUCGCAUGUAAGAAACCAUGA | 1550 | 884-906 |
| AD-1589471 | CCGCGGCAUUUGCAGUUUUUU | 1438 | 993-1013 | AAAAAACUGCAAAUGCCGCGGUU | 1551 | 991-1013 |
| AD-1589474 | CGGCAUUUGCAGUUUUUCAGU | 1439 | 996-1016 | ACUGAAAAACUGCAAAUGCCGCG | 1552 | 994-1016 |
| AD-1589479 | UUGCAGUUUUUCAGCGAAUUU | 1440 | 1002-1022 | AAAUUCGCUGAAAAACUGCAAAU | 1553 | 1000-1022 |
| AD-1589481 | GCAGUUUUUCAGCGAAUUUGU | 1441 | 1004-1024 | ACAAAUUCGCUGAAAAACUGCAA | 1554 | 1002-1024 |
| AD-1589482 | CAGUUUUUCAGCGAAUUUGGU | 1442 | 1005-1025 | ACCAAAUUCGCUGAAAAACUGCA | 1555 | 1003-1025 |
| AD-1589484 | GUUUUUCAGCGAAUUUGGCAU | 1443 | 1007-1027 | AUGCCAAAUUCGCUGAAAAACUG | 1556 | 1005-1027 |
| AD-1589489 | CAGCGAAUUUGGCAAUAGUGU | 1444 | 1013-1033 | ACACUAUUGCCAAAUUCGCUGAA | 1557 | 1011-1033 |
| AD-1589492 | CGAAUUUGGCAAUAGUGAUAU | 1445 | 1016-1036 | AUAUCACUAUUGCCAAAUUCGCU | 1558 | 1014-1036 |
| AD-1589495 | AUUUGGCAAUAGUGAUAUUUU | 1446 | 1019-1039 | AAAAUAUCACUAUUGCCAAAUUC | 1559 | 1017-1039 |
| AD-1589500 | CAAUAGUGAUAUUUAUGUGUU | 1447 | 1025-1045 | AACACAUAAAUAUCACUAUUGCC | 1560 | 1023-1045 |
| AD-1589502 | AUAGUGAUAUUUAUGUGUCAU | 1448 | 1027-1047 | AUGACACAUAAAUAUCACUAUUG | 1561 | 1025-1047 |
| AD-1589503 | UAGUGAUAUUUAUGUGUCACU | 1449 | 1028-1048 | AGUGACACAUAAAUAUCACUAUU | 1562 | 1026-1048 |
| AD-1589505 | GUGAUAUUUAUGUGUCACUGU | 1450 | 1030-1050 | ACAGUGACACAUAAAUAUCACUA | 1563 | 1028-1050 |

TABLE 8-continued

Additional Human Unmodified Sense and Antisense Strand Sequences of GRB14 dsRNA Agents

| Duplex ID | Sense Sequence 5' to 3' | SEQ ID NO: | Range in NM_ 004490.3 | Antisense Sequence 5' to 3' | SEQ ID NO: | Range in NM_ 004490.3 |
|---|---|---|---|---|---|---|
| AD-1589510 | UUUAUGUGUC ACUGGCAGGC U | 1451 | 1036-1056 | AGCCUGCCAG UGACACAUAA AUA | 1564 | 1034-1056 |
| AD-1589513 | AUGUGUCACU GGCAGGCAAA U | 1452 | 1039-1059 | AUUUGCCUGC CAGUGACACA UAA | 1565 | 1037-1059 |
| AD-1589518 | AUGGAGCACC GACUAACUAU U | 1453 | 1066-1086 | AAUAGUUAGU CGGUGCUCCA UGU | 1566 | 1064-1086 |
| AD-1589520 | GGAGCACCGA CUAACUAUGG U | 1454 | 1068-1088 | ACCAUAGUUA GUCGGUGCUC CAU | 1567 | 1066-1088 |
| AD-1589521 | GAGCACCGAC UAACUAUGGA U | 1455 | 1069-1089 | AUCCAUAGUU AGUCGGUGCU CCA | 1568 | 1067-1089 |
| AD-1589523 | GCACCGACUA ACUAUGGAUU U | 1456 | 1071-1091 | AAAUCCAUAG UUAGUCGGUG CUC | 1569 | 1069-1091 |
| AD-1589528 | ACUAACUAUG GAUUCUGCUU U | 1457 | 1077-1097 | AAAGCAGAAU CCAUAGUUAG UCG | 1570 | 1075-1097 |
| AD-1589531 | AACUAUGGAU UCUGCUUUAA U | 1458 | 1080-1100 | AUUAAAGCAG AAUCCAUAGU UAG | 1571 | 1078-1100 |
| AD-1589625 | UGCAGCUGUA CCAGAAUUAU U | 1459 | 1204-1224 | AAUAAUUCUG GUACAGCUGC AUG | 1572 | 1202-1224 |
| AD-1589628 | AGCUGUACCA GAAUUAUAUG U | 1460 | 1207-1227 | ACAUAUAAUU CUGGUACAGC UGC | 1573 | 1205-1227 |
| AD-1589633 | ACCAGAAUUA UAUGCAUCCA U | 1461 | 1213-1233 | AUGGAUGCAU AUAAUUCUGG UAC | 1574 | 1211-1233 |
| AD-1589636 | AGAAUUAUAU GCAUCCAUAU U | 1462 | 1216-1236 | AAUAUGGAUG CAUAUAAUUC UGG | 1575 | 1214-1236 |
| AD-1589665 | GGCUGCAGUU CACAGAGCAU U | 1463 | 1248-1268 | AAUGCUCUGU GAACUGCAGC CAC | 1576 | 1246-1268 |
| AD-1589668 | UGCAGUUCAC AGAGCAUAUC U | 1464 | 1251-1271 | AGAUAUGCUC UGUGAACUGC AGC | 1577 | 1249-1271 |
| AD-1589673 | UCACAGAGCA UAUCACCUAU U | 1465 | 1257-1277 | AAUAGGUGAU AUGCUCUGUG AAC | 1578 | 1255-1277 |
| AD-1589676 | CAGAGCAUAU CACCUAUGAG U | 1466 | 1260-1280 | ACUCAUAGGU GAUAUGCUCU GUG | 1579 | 1258-1280 |
| AD-1589685 | CACCUAUGAG AAGUAUAUCA U | 1467 | 1270-1290 | AUGAUAUACU UCUCAUAGGU GAU | 1580 | 1268-1290 |
| AD-1589688 | CUAUGAGAAG UAUAUCAGAG U | 1468 | 1273-1293 | ACUCUGAUAU ACUUCUCAUA GGU | 1581 | 1271-1293 |

TABLE 8-continued

Additional Human Unmodified Sense and Antisense Strand Sequences of GRB14 dsRNA Agents

| Duplex ID | Sense Sequence 5' to 3' | SEQ ID NO: | Range in NM_ 004490.3 | Antisense Sequence 5' to 3' | SEQ ID NO: | Range in NM_ 004490.3 |
|---|---|---|---|---|---|---|
| AD-1589693 | GAAGUAUAUCAGAGAAUUCCU | 1469 | 1279-1299 | AGGAAUUCUCUGAUAUACUUCUC | 1582 | 1277-1299 |
| AD-1589695 | AGUAUAUCAGAGAAUUCCCUU | 1470 | 1281-1301 | AAGGGAAUUCUCUGAUAUACUUC | 1583 | 1279-1301 |
| AD-1589696 | GUAUAUCAGAGAAUUCCCUGU | 1471 | 1282-1302 | ACAGGGAAUUCUCUGAUAUACUU | 1584 | 1280-1302 |
| AD-1589698 | AUAUCAGAGAAUUCCCUGGUU | 1472 | 1284-1304 | AACCAGGGAAUUCUCUGAUAUAC | 1585 | 1282-1304 |
| AD-1589703 | GAGAAUUCCCUGGUAGCAAUU | 1473 | 1290-1310 | AAUUGCUACCAGGGAAUUCUCUG | 1586 | 1288-1310 |
| AD-1589705 | GAAUUCCCUGGUAGCAAUGGU | 1474 | 1292-1312 | ACCAUUGCUACCAGGGAAUUCUC | 1587 | 1290-1312 |
| AD-1589706 | AAUUCCCUGGUAGCAAUGGAU | 1475 | 1293-1313 | AUCCAUUGCUACCAGGGAAUUCU | 1588 | 1291-1313 |
| AD-1589708 | UUCCCUGGUAGCAAUGGACUU | 1476 | 1295-1315 | AAGUCCAUUGCUACCAGGGAAUU | 1589 | 1293-1315 |
| AD-1589713 | GGUAGCAAUGGACUUCUCAGU | 1477 | 1301-1321 | ACUGAGAAGUCCAUUGCUACCAG | 1590 | 1299-1321 |
| AD-1589716 | AGCAAUGGACUUCUCAGGCCU | 1478 | 1304-1324 | AGGCCUGAGAAGUCCAUUGCUAC | 1591 | 1302-1324 |
| AD-1589842 | CAGCCAUGGUUUCACCACAAU | 1479 | 1482-1502 | AUUGUGGUGAAACCAUGGCUGGG | 1592 | 1480-1502 |
| AD-1589845 | CCAUGGUUUCACCACAAAAUU | 1480 | 1485-1505 | AAUUUUGUGGUGAAACCAUGGCU | 1593 | 1483-1505 |
| AD-1589850 | UUUCACCACAAAAUUUCUAGU | 1481 | 1491-1511 | ACUAGAAAUUUUGUGGUGAAACC | 1594 | 1489-1511 |
| AD-1589853 | CACCACAAAAUUUCUAGAGAU | 1482 | 1494-1514 | AUCUCUAGAAAUUUUGUGGUGAA | 1595 | 1492-1514 |
| AD-1589902 | GUGGAUGGAGUUUUCUUGGUU | 1483 | 1548-1568 | AACCAAGAAAACUCCAUCCACAA | 1596 | 1546-1568 |
| AD-1589905 | GAUGGAGUUUUCUUGGUACGU | 1484 | 1551-1571 | ACGUACCAAGAAAACUCCAUCCA | 1597 | 1549-1571 |
| AD-1589910 | GUUUUCUUGGUACGGGAUAGU | 1485 | 1557-1577 | ACUAUCCCGUACCAAGAAAACUC | 1598 | 1555-1577 |
| AD-1589913 | UUCUUGGUACGGGAUAGUCAU | 1486 | 1560-1580 | AUGACUAUCCCGUACCAAGAAAA | 1599 | 1558-1580 |

TABLE 8-continued

Additional Human Unmodified Sense and Antisense Strand Sequences of GRB14 dsRNA Agents

| Duplex ID | Sense Sequence 5' to 3' | SEQ ID NO: | Range in NM_ 004490.3 | Antisense Sequence 5' to 3' | SEQ ID NO: | Range in NM_ 004490.3 |
|---|---|---|---|---|---|---|
| AD-1589923 | AACUUUCGUACUGUCAAUGAU | 1487 | 1592-1612 | AUCAUUGACAGUACGAAAGUUUU | 1600 | 1590-1612 |
| AD-1589925 | CUUUCGUACUGUCAAUGAGUU | 1488 | 1594-1614 | AACUCAUUGACAGUACGAAAGUU | 1601 | 1592-1614 |
| AD-1589926 | UUUCGUACUGUCAAUGAGUCU | 1489 | 1595-1615 | AGACUCAUUGACAGUACGAAAGU | 1602 | 1593-1615 |
| AD-1589928 | UCGUACUGUCAAUGAGUCAUU | 1490 | 1597-1617 | AAUGACUCAUUGACAGUACGAAA | 1603 | 1595-1617 |
| AD-1589933 | UGUCAAUGAGUCAUGGACAAU | 1491 | 1603-1623 | AUUGUCCAUGACUCAUUGACAGU | 1604 | 1601-1623 |
| AD-1590015 | UAAUACAGCUGGUGGAGUUCU | 1492 | 1711-1731 | AGAACUCCACCAGCUGUAUUAGA | 1605 | 1709-1731 |
| AD-1590018 | UACAGCUGGUGGAGUUCUAUU | 1493 | 1714-1734 | AAUAGAACUCCACCAGCUGUAUU | 1606 | 1712-1734 |
| AD-1590023 | UGGUGGAGUUCUAUCAACUCU | 1494 | 1720-1740 | AGAGUUGAUAGAACUCCACCAGC | 1607 | 1718-1740 |
| AD-1590026 | UGGAGUUCUAUCAACUCAAUU | 1495 | 1723-1743 | AAUUGAGUUGAUAGAACUCCACC | 1608 | 1721-1743 |
| AD-1590045 | AGGGCGUUCUUCCUUGCAAGU | 1496 | 1744-1764 | ACUUGCAAGGAAGAACGCCCUUA | 1609 | 1742-1764 |
| AD-1590048 | GCGUUCUUCCUUGCAAGUUGU | 1497 | 1747-1767 | ACAACUUGCAAGGAAGAACGCCC | 1610 | 1745-1767 |
| AD-1590053 | UUCCUUGCAAGUUGAAACAUU | 1498 | 1753-1773 | AAUGUUUCAACUUGCAAGGAAGA | 1611 | 1751-1773 |
| AD-1590056 | CUUGCAAGUUGAAACAUUAUU | 1499 | 1756-1776 | AAUAAUGUUUCAACUUGCAAGGA | 1612 | 1754-1776 |
| AD-1590085 | GCUCUCUAGACAAGCCAGAAU | 1500 | 1788-1808 | AUUCUGGCUUGUCUAGAGAGCAA | 1613 | 1786-1808 |
| AD-1590088 | CUCUAGACAAGCCAGAAGUGU | 1501 | 1791-1811 | ACACUUCUGGCUUGUCUAGAGAG | 1614 | 1789-1811 |
| AD-1590093 | ACAAGCCAGAAGUGACUUAUU | 1502 | 1797-1817 | AAUAAGUCACUUCUGGCUUGUCU | 1615 | 1795-1817 |
| AD-1590096 | AGCCAGAAGUGACUUAUUAAU | 1503 | 1800-1820 | AUUAAUAAGUCACUUCUGGCUUG | 1616 | 1798-1820 |
| AD-1590145 | AGGGCGAAAACAUUACCAUGU | 1504 | 1868-1888 | ACAUGGUAAUGUUUUCGCCCUUA | 1617 | 1866-1888 |

TABLE 8-continued

Additional Human Unmodified Sense and Antisense Strand Sequences of GRB14 dsRNA Agents

| Duplex ID | Sense Sequence 5' to 3' | SEQ ID NO: | Range in NM_ 004490.3 | Antisense Sequence 5' to 3' | SEQ ID NO: | Range in NM_ 004490.3 |
|---|---|---|---|---|---|---|
| AD-1590148 | GCGAAAACAUUACCAUGUGAU | 1505 | 1871-1891 | AUCACAUGGUAAUGUUUUCGCCC | 1618 | 1869-1891 |
| AD-1590153 | ACAUUACCAUGUGAAAAGAAU | 1506 | 1877-1897 | AUUCUUUUCACAUGGUAAUGUUU | 1619 | 1875-1897 |
| AD-1590155 | AUUACCAUGUGAAAAGAAUGU | 1507 | 1879-1899 | ACAUUCUUUUCACAUGGUAAUGU | 1620 | 1877-1899 |
| AD-1590156 | UUACCAUGUGAAAAGAAUGUU | 1508 | 1880-1900 | AACAUUCUUUUCACAUGGUAAUG | 1621 | 1878-1900 |
| AD-1590158 | ACCAUGUGAAAAGAAUGUAUU | 1509 | 1882-1902 | AAUACAUUCUUUUCACAUGGUAA | 1622 | 1880-1902 |
| AD-1590163 | UGAAAAGAAUGUAUUUCACCU | 1510 | 1888-1908 | AGGUGAAAUACAUUCUUUUCACA | 1623 | 1886-1908 |
| AD-1590166 | AAAGAAUGUAUUUCACCUGCU | 1511 | 1891-1911 | AGCAGGUGAAAUACAUUCUUUUC | 1624 | 1889-1911 |
| AD-1590192 | CAAAUAAGCAAAGACUUGGAU | 1512 | 1939-1959 | AUCCAAGUCUUUGCUUAUUUGCA | 1625 | 1937-1959 |
| AD-1590195 | AUAAGCAAAGACUUGGAUUGU | 1513 | 1942-1962 | ACAAUCCAAGUCUUUGCUUAUUU | 1626 | 1940-1962 |
| AD-1590200 | AAAGACUUGGAUUGACUUUAU | 1514 | 1948-1968 | AUAAAGUCAAUCCAAGUCUUUGC | 1627 | 1946-1968 |
| AD-1590203 | GACUUGGAUUGACUUUACAUU | 1515 | 1951-1971 | AAUGUAAAGUCAAUCCAAGUCUU | 1628 | 1949-1971 |
| AD-1631258 | UGAAGUGCUAUCCAACUGGGU | 2643 | 686-706 | ACCCAGUUGGAUAGCACUUCAAU | 2657 | 684-706 |
| AD-1631259 | CUGGGGGAUAGAAGAAGAAAU | 2644 | 701-721 | AUUUCUUCUUCUAUCCCCCAGUU | 2658 | 699-721 |
| AD-1631260 | GGGGAUAGAAGAAGAAAACAU | 2645 | 704-724 | AUGUUUUCUUCUUCUAUCCCCCA | 2659 | 702-724 |
| AD-1631261 | GAAAAAAUUAUGCCAAAUAUU | 2646 | 736-756 | AAUAUUUGGCAUAAUUUUUUCUA | 2660 | 734-756 |
| AD-1631262 | AAAAUUAUGCCAAAUAUGAGU | 2647 | 739-759 | ACUCAUAUUUGGCAUAAUUUUUU | 2661 | 737-759 |
| AD-1631263 | CCAAAUAUGAGUUCUUUAAAU | 2648 | 748-768 | AUUUAAAGAACUCAUAUUUGGCA | 2662 | 746-768 |

TABLE 8-continued

Additional Human Unmodified Sense and Antisense Strand Sequences of GRB14 dsRNA Agents

| Duplex ID | Sense Sequence 5' to 3' | SEQ ID NO: | Range in NM_ 004490.3 | Antisense Sequence 5' to 3' | SEQ ID NO: | Range in NM_ 004490.3 |
|---|---|---|---|---|---|---|
| AD-1631264 | AAAAACCCAAUGUAUUUUUUU | 2649 | 765-785 | AAAAAAAUACAUUGGGUUUUUAA | 2663 | 763-785 |
| AD-1631265 | CCAAUGUAUUUUUUUCCAGAU | 2650 | 771-791 | AUCUGGAAAAAAAUACAUUGGGU | 2664 | 769-791 |
| AD-1631266 | AUGUAUUUUUUUCCAGAGCAU | 2651 | 774-794 | AUGCUCUGGAAAAAAAUACAUUG | 2665 | 772-794 |
| AD-1631267 | AAAAAAAACAUGGAGCACCGU | 2652 | 1057-1077 | ACGGUGCUCCAUGUUUUUUUUUG | 2666 | 1055-1077 |
| AD-1631268 | AAAAACAUGGAGCACCGACUU | 2653 | 1060-1080 | AAGUCGGUGCUCCAUGUUUUUUU | 2667 | 1058-1080 |
| AD-1631269 | UAACCCCAAAACUUUCGUACU | 2654 | 1583-1603 | AGUACGAAAGUUUUGGGGUUACU | 2668 | 1581-1603 |
| AD-1631270 | CCCCAAAACUUUCGUACUGUU | 2655 | 1586-1606 | AACAGUACGAAAGUUUUGGGGUU | 2669 | 1584-1606 |
| AD-1631271 | CAAUGAGUCAUGGACAAAAAU | 2656 | 1606-1626 | AUUUUUGUCCAUGACUCAUUGAC | 2670 | 1604-1626 |

TABLE 9

Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1399762 | gscscggcGfaCfAfAfugaccacuuuL96 | 998 | asAfsaguGfgUfCfauugUfcGfccggcscsg | 1133 | CGGCCGGCGACAAUGACCACUUC | 1268 |
| AD-1399763 | usgsaccaCfuUfCfCfcugcaagauuL96 | 999 | asAfsucuUfgCfAfgggaAfgUfggucasusu | 1134 | AAUGACCACUUCCCUGCAAGAUG | 1269 |
| AD-1399764 | gscsugugCfuGfCfAfgacaggagauL96 | 1000 | asUfscucCfuGfUfcugcAfgCfacagcscsg | 1135 | CGGCUGUGCUGCAGACAGGAGAA | 1270 |
| AD-1399765 | asasgaaaGfaUfCfUfugauguuccuL96 | 1001 | asGfsgaaCfaUfCfaagaUfcUfuucuususu | 1136 | AAAAGAAAGAUCUUGAUGUUCCG | 1271 |
| AD-1399766 | usgsauguUfcCfGfGfaaaugccauuL96 | 1002 | asAfsuggCfaUfUfuccgGfaAfcaucasasg | 1137 | CUUGAUGUUCCGGAAAUGCCAUC | 1272 |
| AD-1399767 | asasaugcCfaUfCfUfauuccaaacuL96 | 1003 | asGfsuuuGfgAfAfuagaUfgGfcauuuscsc | 1138 | GGAAAUGCCAUCUAUUCCAAACC | 1273 |
| AD-1399768 | asusuccaAfaCfCfCfuuuuccugauL96 | 1004 | asUfscagGfaAfAfagggUfuUfggaausasg | 1139 | CUAUUCCAAACCCUUUUCCUGAG | 1274 |

TABLE 9-continued

Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1399769 | ususuuccUfgAfGfCfuaugcuguuuL96 | 1005 | asAfsacaGfcAfUfagcuCfaGfgaaaasgsg | 1140 | CCUUUUCCUGAGCUAUGCUGUUC | 1275 |
| AD-1399770 | usasugcuGfuUfCfUfccauuuacauL96 | 1006 | asUfsguaAfaUfGfgagaAfcAfgcauasgsc | 1141 | GCUAUGCUGUUCUCCAUUUACAU | 1276 |
| AD-1399771 | cscsauuuAfcAfUfCfuguguugucuL96 | 1007 | asGfsacaAfcAfCfagauGfuAfaauggsasg | 1142 | CUCCAUUUACAUCUGUGUUGUCA | 1277 |
| AD-1399772 | usgsuguuGfuCfAfGfcagaccuauuL96 | 1008 | asAfsuagGfuCfUfgcugAfcAfacacasgsa | 1143 | UCUGUGUUGUCAGCAGACCUAUU | 1278 |
| AD-1399773 | csasgaccUfaUfUfUfcccaaagcauL96 | 1009 | asUfsgcuUfuGfGfgaaaUfaGfgucugscsu | 1144 | AGCAGACCUAUUUCCCAAAGCAA | 1279 |
| AD-1399774 | cscscaaaGfcAfAfAfuucaaggaauL96 | 1010 | asUfsuccUfuGfAfauuuGfcUfuugggsasa | 1145 | UUCCCAAAGCAAAUUCAAGGAAA | 1280 |
| AD-1399775 | asascaggUfgAfUfUfaaaguauacuL96 | 1011 | asGfsuauAfcUfUfuaauCfaCfcuguusGsu | 1146 | AAAACAGGUGAUUAAAGUAUACA | 1281 |
| AD-1399776 | asasaguaUfaCfAfGfugaagaugauL96 | 1012 | asUfscauCfuUfCfacugUfaUfacuuusasa | 1147 | UUAAAGUAUACAGUGAAGAUGAA | 1282 |
| AD-1399777 | usgsaagaUfgAfAfAfccagcaggguL96 | 1013 | asCfsccuGfcUfGfguuuCfaUfcuucascsu | 1148 | AGUGAAGAUGAAACCAGCAGGGC | 1283 |
| AD-1399778 | cscsagcaGfgGfCfUfuuagauguauL96 | 1014 | asUfsacaUfcUfAfaagcCfcUfgcuggsusu | 1149 | AACCAGCAGGGCUUUAGAUGUAC | 1284 |
| AD-1399779 | ususagauGfuAfCfCfcagugacauuL96 | 1015 | asAfsuguCfaCfUfggguAfcAfucuaasasg | 1150 | CUUUAGAUGUACCCAGUGACAUA | 1285 |
| AD-1399780 | csasgugaCfaUfAfAfcggcucgaguL96 | 1016 | asCfsucgAfgCfCfguuaUfgUfcacugsgsg | 1151 | CCCAGUGACAUAACGGCUCGAGA | 1286 |
| AD-1399781 | csgsgcucGfaGfAfUfguuugucaguL96 | 1017 | asCfsugaCfaAfAfcaucUfcGfagccgsusu | 1152 | AACGGCUCGAGAUGUUUGUCAGC | 1287 |
| AD-1399782 | gsusuuguCfaGfCfUfguugauccuuL96 | 1018 | asAfsggaUfcAfAfcagcUfgAfcaaacsasu | 1153 | AUGUUUGUCAGCUGUUGAUCCUG | 1288 |
| AD-1399783 | gsusugauCfcUfGfAfagaaucauuuL96 | 1019 | asAfsaugAfuUfCfuucaGfgAfucaacsasg | 1154 | CUGUUGAUCCUGAAGAAUCAUUA | 1289 |
| AD-1399784 | asgsaaucAfuUfAfCfauugaugacuL96 | 1020 | asGfsucaUfcAfAfuguaAfuGfauucususc | 1155 | GAAGAAUCAUUACAUUGAUGACC | 1290 |
| AD-1399785 | asusugauGfaCfCfAfcagcuggacuL96 | 1021 | asGfsuccAfgCfUfgugGUfcAfucaausgsu | 1156 | ACAUUGAUGACCACAGCUGGACC | 1291 |
| AD-1399786 | csasgcugGfaCfCfCfuuuuugagcuL96 | 1022 | asGfscucAfaAfAfagggUfcCfagcugsusg | 1157 | CACAGCUGGACCCUUUUGAGCA | 1292 |

TABLE 9-continued

Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1399787 | ususuuugAfgCfAfCfcugccucacuL96 | 1023 | asGfsugaGfgCfAfggugCfuCfaaaaasgsg | 1158 | CCUUUUUGAGCACCUGCCUCACA | 1293 |
| AD-1399788 | csusgccuCfaCfAfUfagguguagauL96 | 1024 | asUfscuaCfaCfCfuaugUfgAfggcagsgsu | 1159 | ACCUGCCUCACAUAGGUGUAGAA | 1294 |
| AD-1399789 | asgsguguAfgAfAfAfgaacaauaguL96 | 1025 | asCfsuauUfgUfUfcuuuCfuAfcaccusasu | 1160 | AUAGGUGUAGAAAGAACAAUAGA | 1295 |
| AD-1399790 | gsasacaaUfaGfAfAfgaccacgaauL96 | 1026 | asUfsucgUfgGfUfcuucUfaUfuguucsusu | 1161 | AAGAACAAUAGAAGACCACGAAC | 1296 |
| AD-1399791 | gsasccacGfaAfCfUfggugauugauL96 | 1027 | asUfscaaUfcAfCfcaguUfcGfuggucsusu | 1162 | AAGACCACGAACUGGUGAUUGAA | 1297 |
| AD-1399792 | gsgsugauUfgAfAfGfugcuauccauL96 | 1028 | asUfsggaUfaGfCfacuuCfaAfucaccsasg | 1163 | CUGGUGAUUGAAGUGCUAUCCAA | 1298 |
| AD-1399793 | gsasuagaAfgAfAfGfaaaacaaacuL96 | 1029 | asGfsuuuGfuUfUfucuuCfuUfcuaucscsc | 1164 | GGGAUAGAAGAAGAAAACAAACU | 1299 |
| AD-1399794 | asusuaugCfcAfAfAfuaugaguucuL96 | 1030 | asGfsaacUfcAfUfauuuGfgCfauaausu su | 1165 | AAAUUAUGCCAAAUAUGAGUUCU | 1300 |
| AD-1399795 | asascccaAfuGfUfAfuuuuuuuccuL96 | 1031 | asGfsgaaAfaAfAfauacAfuUfggguususu | 1166 | AAAACCCAAUGUAUUUUUUUCCA | 1301 |
| AD-1399796 | ususuuuuUfcCfAfGfagcauagguL96 | 1032 | asCfscauAfuGfCfucugGfaAfaaaaasusa | 1167 | UAUUUUUUUCCAGAGCAUAUGGU | 1302 |
| AD-1399797 | asgscauaUfgGfUfAfucuuuugcauL96 | 1033 | asUfsgcaAfaAfGfauacCfaUfaugcuscsu | 1168 | AGAGCAUAUGGUAUCUUUUGCAA | 1303 |
| AD-1399798 | uscsuuuuGfcAfAfCfugaaaccaauL96 | 1034 | asUfsuggUfuUfCfaguuGfcAfaaagasusa | 1169 | UAUCUUUUGCAACUGAAACCAAU | 1304 |
| AD-1399799 | usgsaaacCfaAfUfGfgugaaauauuL96 | 1035 | asAfsuauUfuCfAfccauUfgGfuuucasgsu | 1170 | ACUGAAACCAAUGGUGAAAUAUC | 1305 |
| AD-1399800 | csascacaGfaUfUfUfugcagauguuL96 | 1036 | asAfscauCfuGfCfaaaaUfcUfgugugsgsg | 1171 | CCCACACAGAUUUUGCAGAUGUU | 1306 |
| AD-1399801 | usgscagaUfgUfUfUfcugaguucauL96 | 1037 | asUfsgaaCfuCfAfgaaaCfaUfcugcasasa | 1172 | UUUGCAGAUGUUUCUGAGUUCAA | 1307 |
| AD-1399802 | csusgaguUfcAfAfGfcacauauccuL96 | 1038 | asGfsgauAfuGfUfgcuuGfaAfcucagsasa | 1173 | UUCUGAGUUCAAGCACAUAUCCU | 1308 |
| AD-1399803 | csascauaUfcCfUfGfaaauucauguL96 | 1039 | asCfsaugAfaUfUfucagGfaUfaugugscsu | 1174 | AGCACAUAUCCUGAAAUUCAUGG | 1309 |
| AD-1399804 | asasauucAfuGfGfUfuucuuacauuL96 | 1040 | asAfsuguAfaGfAfaaccAfuGfaauuuscsa | 1175 | UGAAAUUCAUGGUUUCUUACAUG | 1310 |

TABLE 9-continued

Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1399805 | ususcuuaCfaUfGfCfgaaagaacauL96 | 1041 | asUfsguuCfuUfUfcgcaUfgUfaagaasasc | 1176 | GUUUCUUACAUGCGAAAGAACAG | 1311 |
| AD-1399806 | gsasaagaAfcAfGfGfgaaagaaguuL96 | 1042 | asAfscuuCfuUfUfcccuGfuUfcuucsgsc | 1177 | GCGAAAGAACAGGGAAAGAAGUC | 1312 |
| AD-1399807 | csusuuuuUfcUfAfAfgaagaucuguL96 | 1043 | asCfsagaUfcUfUfcuuaGfaAfaaaagsusa | 1178 | UACUUUUUUCUAAGAAGAUCUGG | 1313 |
| AD-1399808 | asgsaucuGfgUfUfUfauauuuucuL96 | 1044 | asGfsaaaAfaUfAfuaaaCfcAfgaucussc | 1179 | GAAGAUCUGGUUUAUAUUUUUCU | 1314 |
| AD-1399809 | ususuucuAfcUfAfAfaggaacaucuL96 | 1045 | asGfsaugUfuCfCfuuuaGfuAfgaaaasasu | 1180 | AUUUUUCUACUAAAGGAACAUCA | 1315 |
| AD-1399810 | asgsgaacAfuCfAfAfaggaaccgcuL96 | 1046 | asGfscggUfuCfCfuuugAfuGfuuccususu | 1181 | AAAGGAACAUCAAAGGAACCGCG | 1316 |
| AD-1399811 | asgsgaacCfgCfGfGfcauuugcaguL96 | 1047 | asCfsugcAfaAfUfgccgCfgGfuuccususu | 1182 | AAAGGAACCGCGGCAUUUGCAGU | 1317 |
| AD-1399812 | csasuuugCfaGfUfUfuuucagcgauL96 | 1048 | asUfscgcUfgAfAfaaacUfgCfaaaugscsc | 1183 | GGCAUUUGCAGUUUUUCAGCGAA | 1318 |
| AD-1399813 | ususucagCfgAfAfUfuuggcaauauL96 | 1049 | asUfsauuGfcCfAfaauuCfgCfugaaasasa | 1184 | UUUUUCAGCGAAUUUGGCAAUAG | 1319 |
| AD-1399814 | usgsgcaaUfaGfUfGfauauuuauguL96 | 1050 | asCfsauaAfaUfAfucacUfaUfugccasasa | 1185 | UUUGGCAAUAGUGAUAUUUAUGU | 1320 |
| AD-1399815 | asusauuuAfuGfUfGfucacuggcauL96 | 1051 | asUfsgccAfgUfGfacacAfuAfaauauscsa | 1186 | UGAUAUUUAUGUGUCACUGGCAG | 1321 |
| AD-1399816 | asascaugGfaGfCfAfccgacuaacuL96 | 1052 | asGfsuuaGfuCfGfgugcUfcCfauguusu | 1187 | AAAACAUGGAGCACCGACUAACU | 1322 |
| AD-1399817 | cscsgacuAfaCfUfAfuggauucuguL96 | 1053 | asCfsagaAfuCfCfauagUfuAfgucggsusg | 1188 | CACCGACUAACUAUGGAUUCUGC | 1323 |
| AD-1399818 | usgsgauuCfuGfCfUfuuaagccuauL96 | 1054 | asUfsaggCfuUfAfaagcAfgAfauccasusa | 1189 | UAUGGAUUCUGCUUUAAGCCUAA | 1324 |
| AD-1399819 | ususaagcCfuAfAfCfaaagcgggauL96 | 1055 | asUfscccGfcUfUfuguuAfgGfcuuaasasg | 1190 | CUUUAAGCCUAACAAAGCGGGAG | 1325 |
| AD-1399820 | csgsagacCfuGfAfAfaaugcucuguL96 | 1056 | asCfsagaGfcAfUfuuucAfgGfucucgsgsg | 1191 | CCCGAGACCUGAAAAUGCUCUGU | 1326 |
| AD-1399821 | asasugcuCfuGfUfGfcagaagaaguL96 | 1057 | asCfsuucUfuCfUfgcacAfgAfgcaususu | 1192 | AAAAUGCUCUGUGCAGAAGAAGA | 1327 |
| AD-1399822 | csasgaagAfaGfAfGfcagaguagguL96 | 1058 | asCfscuaCfuCfUfgcucUfuCfuucugscsa | 1193 | UGCAGAAGAAGAGCAGAGUAGGA | 1328 |

TABLE 9-continued

Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1399823 | csasgaguAfgGfAfCfgugcuggguuL96 | 1059 | asAfscccAfgCfAfcgucCfuAfcucugscsu | 1194 | AGCAGAGUAGGACGUGCUGGGUG | 1329 |
| AD-1399824 | gsusgcugGfgUfGfAfccgcgauuauL96 | 1060 | asUfsaauCfgCfGfgucaCfcCfagcacsgsu | 1195 | ACGUGCUGGGUGACCGCGAUUAG | 1330 |
| AD-1399825 | cscsgcgaUfuAfGfAfuugcuuaaguL96 | 1061 | asCfsuuaAfgCfAfaucuAfaUfcgcggsusc | 1196 | GACCGCGAUUAGAUUGCUUAAGU | 1331 |
| AD-1399826 | ususgcuuAfaGfUfAfuggcaugcauL96 | 1062 | asUfsgcaUfgCfCfauacUfuAfagcaasusc | 1197 | GAUUGCUUAAGUAUGGCAUGCAG | 1332 |
| AD-1399827 | usgsgcauGfcAfGfCfuguaccagauL96 | 1063 | asUfscugGfuAfCfagcuGfcAfugccasusa | 1198 | UAUGGCAUGCAGCUGUACCAGAA | 1333 |
| AD-1399828 | usgsuaccAfgAfAfUfuauaugcauuL96 | 1064 | asAfsugcAfuAfUfaauuCfuGfguacasgsc | 1199 | GCUGUACCAGAAUUAUAUGCAUC | 1334 |
| AD-1399829 | usasuaugCfaUfCfCfauaucaagguL96 | 1065 | asCfscuuGfaUfAfuggaUfgCfauauasasu | 1200 | AUUAUAUGCAUCCAUAUCAAGGU | 1335 |
| AD-1399830 | asusaucaAfgGfUfAfgaaguggcuuL96 | 1066 | asAfsgccAfcUfUfcuacCfuUfgauausgsg | 1201 | CCAUAUCAAGGUAGAAGUGGCUG | 1336 |
| AD-1399831 | gsasagugGfcUfGfCfaguucacaguL96 | 1067 | asCfsuguGfaAfCfugcaGfcCfacuucsusa | 1202 | UAGAAGUGGCUGCAGUUCACAGA | 1337 |
| AD-1399832 | asgsuucaCfaGfAfGfcauaucaccuL96 | 1068 | asGfsgugAfuAfUfgcucUfgUfgaacusgsc | 1203 | GCAGUUCACAGAGCAUAUCACCU | 1338 |
| AD-1399833 | csasuaucAfcCfUfAfugagaaguauL96 | 1069 | asUfsacuUfcUfCfauagGfuGfauaugscsu | 1204 | AGCAUAUCACCUAUGAGAAGUAU | 1339 |
| AD-1399834 | usgsagaaGfuAfUfAfucagagaauuL96 | 1070 | asAfsuucUfcUfGfauauAfcUfucucasusa | 1205 | UAUGAGAAGUAUAUCAGAGAAUU | 1340 |
| AD-1399835 | uscsagagAfaUfUfCfccugguagcuL96 | 1071 | asGfscuaCfcAfGfggaaUfuCfucugasusa | 1206 | UAUCAGAGAAUUCCCUGGUAGCA | 1341 |
| AD-1399836 | cscsugguAfgCfAfAfuggacuucuuL96 | 1072 | asAfsgaaGfuCfCfauugCfuAfccaggsgsa | 1207 | UCCCUGGUAGCAAUGGACUUCUC | 1342 |
| AD-1399837 | usgsgacuUfcUfCfAfggccagaaauL96 | 1073 | asUfsuucUfgGfCfcugaGfaAfguccasusu | 1208 | AAUGGACUUCUCAGGCCAGAAAA | 1343 |
| AD-1399838 | gsgsccagAfaAfAfGfcagaguuauuL96 | 1074 | asAfsuaaCfuCfUfgcuuUfuCfuggccsusg | 1209 | CAGGCCAGAAAAGCAGAGUUAUA | 1344 |
| AD-1399839 | csasgaguUfaUfAfGfaaaaucccauL96 | 1075 | asUfsgggAfuUfUfucuaUfaAfcucugscsu | 1210 | AGCAGAGUUAUAGAAAAUCCCAC | 1345 |
| AD-1399840 | asasaaucCfcAfCfUfgaagcccuuuL96 | 1076 | asAfsaggGfcUfUfcaguGfgGfauuuuscsu | 1211 | AGAAAAUCCCACUGAAGCCCUUU | 1346 |

TABLE 9-continued

Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1399841 | gsasagccCfuUfUfCfaguugcgguuL96 | 1077 | asAfsccgCfaAfCfugaaAfgGfgcuucsasg | 1212 | CUGAAGCCCUUUCAGUUGCGGUU | 1347 |
| AD-1399842 | asgsuugcGfgUfUfGfaagaaggacuL96 | 1078 | asGfsuccUfuCfUfucaaCfcGfcaacusgsa | 1213 | UCAGUUGCGGUUGAAGAAGGACU | 1348 |
| AD-1399843 | asasgaagGfaCfUfCfgcuuggagguL96 | 1079 | asCfscucCfaAfGfcgagUfcCfuucuuscsa | 1214 | UGAAGAAGGACUCGCUUGGAGGA | 1349 |
| AD-1399844 | asasggauGfuUfUfAfcgccugggcuL96 | 1080 | asGfscccAfgGfCfguaaAfcAfuccuususu | 1215 | AAAAGGAUGUUUACGCCUGGGCA | 1350 |
| AD-1399845 | csgsccugGfgCfAfCfucacgguaguL96 | 1081 | asCfsuacCfgUfGfagugCfcCfaggcgsusa | 1216 | UACGCCUGGGCACUCACGGUAGC | 1351 |
| AD-1399846 | csascugcCfuCfUfUfcacagagcuuL96 | 1082 | asAfsgcuCfuGfUfgaagAfgGfcagugsgsg | 1217 | CCCACUGCCUCUUCACAGAGCUC | 1352 |
| AD-1399847 | csascagaGfcUfCfUfgccacaaacuL96 | 1083 | asGfsuuuGfuGfGfcagaGfcUfcugugsasa | 1218 | UUCACAGAGCUCUGCCACAAACA | 1353 |
| AD-1399848 | scscacaAfaCfAfUfggcuauccauL96 | 1084 | asUfsggaUfaGfCfcaugUfuUfguggcsasg | 1219 | CUGCCACAAACAUGGCUAUCCAC | 1354 |
| AD-1399849 | gsgscuauCfcAfCfCfggucccagcuL96 | 1085 | asGfscugGfgAfCfcgguGfgAfuagccsasu | 1220 | AUGGCUAUCCACCGGUCCCAGCC | 1355 |
| AD-1399850 | gsgsucccAfgCfCfAfugguuucacuL96 | 1086 | asGfsugaAfaCfCfaggCfuGfggaccsgsg | 1221 | CCGGUCCCAGCCAUGGUUUCACC | 1356 |
| AD-1399851 | usgsguuuCfaCfCfAfcaaaauuucuL96 | 1087 | asGfsaaaUfuUfUfguggUfgAfaaccasusg | 1222 | CAUGGUUUCACCACAAAAUUUCU | 1357 |
| AD-1399852 | csasaaauUfuCfUfAfgagaugagguL96 | 1088 | asCfscucAfuCfUfcuagAfaAfuuuugsusg | 1223 | CACAAAAUUUCUAGAGAUGAGGC | 1358 |
| AD-1399853 | gsasgaugAfgGfCfUfcagcgauuguL96 | 1089 | asCfsaauCfgCfUfga1224gcCfuCfaucucsusa | 1224 | UAGAGAUGAGGCUCAGCGAUUGA | 1359 |
| AD-1399854 | csasgcgaUfuGfAfUfuauucagcauL96 | 1090 | asUfsgcuGfaAfUfaaucAfaUfcgcugsasg | 1225 | CUCAGCGAUUGAUUAUUCAGCAA | 1360 |
| AD-1399855 | usasuucaGfcAfAfGfgacuuguggul96 | 1091 | asCfscacAfaGfUfccuuGfcUfgaauasasu | 1226 | AUUAUUCAGCAAGGACUUGUGGA | 1361 |
| AD-1399856 | gsascuugUfgGfAfUfggaguuuucuL96 | 1092 | asGfsaaaAfcUfCfcaucCfaCfaagucscsu | 1227 | AGGACUUGUGGAUGGAGUUUUCU | 1362 |
| AD-1399857 | gsgsaguuUfuCfUfUfgguacgggauL96 | 1093 | asUfscccGfuAfCfcaagAfaAfacuccsasu | 1228 | AUGGAGUUUUCUUGGUACGGGAU | 1363 |
| AD-1399858 | gsgsuacgGfgAfUfAfgucagaguauL96 | 1094 | asUfsacuCfuGfAfcuauCfcCfguaccsasa | 1229 | UUGGUACGGGAUAGUCAGAGUAA | 1364 |

TABLE 9-continued

Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1399859 | csasaaacUfuUfCfGfuacugucaauL96 | 1095 | asUfsugaCfaGfUfacgaAfaGfuuuugsgsg | 1230 | CCCAAAACUUUCGUACUGUCAAU | 1365 |
| AD-1399860 | usascuguCfaAfUfGfagucauggauL96 | 1096 | asUfsccaUfgAfCfucauUfgAfcaguascsg | 1231 | CGUACUGUCAAUGAGUCAUGGAC | 1366 |
| AD-1399861 | asasgcacUfuUfCfAfaauuauaccuL96 | 1097 | lasGfsguaUfaAfUfuugaAfaGfugcuususa | 1232 | UAAAGCACUUUCAAAUUAUACCA | 1367 |
| AD-1399862 | asasuuauAfcCfAfGfuagaagauguL96 | 1098 | asCfsaucUfuCfUfacugGfuAfuaauususg | 1233 | CAAAUUAUACCAGUAGAAGAUGA | 1368 |
| AD-1399863 | usasgaagAfuGfAfCfggugaaauguL96 | 1099 | asCfsauuUfcAfCfcgucAfuCfuucuascsu | 1234 | AGUAGAAGAUGACGGUGAAAUGU | 1369 |
| AD-1399864 | gsgsugaaAfuGfUfUfccacacacuuL96 | 1100 | asAfsgugUfgUfGfgaacAfuUfucaccsgsu | 1235 | ACGGUGAAAUGUUCCACACACUG | 1370 |
| AD-1399865 | cscsacacAfcUfGfGfaugauggccuL96 | 1101 | asGfsgccAfuCfAfuccaGfuGfuguggsasa | 1236 | UUCCACACACUGGAUGAUGGCCA | 1371 |
| AD-1399866 | asusgaugGfcCfAfCfacaagauuuuL96 | 1102 | asAfsaauCfuUfGfugugGfcCfaucauscsc | 1237 | GGAUGAUGGCCACACAAGAUUUA | 1372 |
| AD-1399867 | ascsaagaUfuUfAfCfagaucuaauuL96 | 1103 | asAfsuuaGfaUfCfuguaAfaUfcuugusgsu | 1238 | ACACAAGAUUUACAGAUCUAAUA | 1373 |
| AD-1399868 | asgsaucuAfaUfAfCfagcugguguuL96 | 1104 | asCfscacCfaGfCfuguaUfuAfgaucusgsu | 1239 | ACAGAUCUAAUACAGCUGGUGGA | 1374 |
| AD-1399869 | asgscuggUfgGfAfGfuucuaucaauL96 | 1105 | asUfsugaUfaGfAfacucCfaCfcagcusgsu | 1240 | ACAGCUGGUGGAGUUCUAUCAAC | 1375 |
| AD-1399870 | ususcuauCfaAfCfUfcaauaaggguL96 | 1106 | asCfsccuUfaUfUfgaguUfgAfuagaascsu | 1241 | AGUUCUAUCAACUCAAUAAGGGC | 1376 |
| AD-1399871 | csasauaaGfgGfCfGfuucuuccuuuL96 | 1107 | asAfsaggAfaGfAfacgcCfcUfuauugsasg | 1242 | CUCAAUAAGGGCGUUCUUCCUUG | 1377 |
| AD-1399872 | ususcuucCfuUfGfCfaaguugaaauL96 | 1108 | asUfsuucAfaCfUfugcaAfgGfaagaascsg | 1243 | CGUUCUUCCUUGCAAGUUGAAAC | 1378 |
| AD-1399873 | asasguugAfaAfCfAfuuauugugcuL96 | 1109 | asGfscacAfaUfAfauguUfuCfaacuusgsc | 1244 | GCAAGUUGAAACAUUAUUGUGCU | 1379 |
| AD-1399874 | ususauugUfgCfUfAfggauugcucuL96 | 1110 | asGfsagcAfaUfCfcuagCfaCfaauaasusg | 1245 | CAUUAUUGUGCUAGGAUUGCUCU | 1380 |
| AD-1399875 | gsgsauugCfuCfUfCfuagacaagcuL96 | 1111 | asGfscuuGfuCfUfagagAfgCfaauccsusa | 1246 | UAGGAUUGCUCUCUAGACAAGCC | 1381 |
| AD-1399876 | usasgacaAfgCfCfAfgaagugacuuL96 | 1112 | asAfsgucAfcUfUfcuggCfuUfgucuasgsa | 1247 | UCUAGACAAGCCAGAAGUGACUU | 1382 |

TABLE 9-continued

Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1399877 | gsasagugAfcUfUfAfuuaaacuauuL96 | 1113 | asAfsuagUfuUfAfauaaGfuCfacuucsusg | 1248 | CAGAAGUGACUUAUUAAACUAUU | 1383 |
| AD-1399878 | usasaacuAfuUfGfAfaggaaaagguL96 | 1114 | asCfscuuUfuCfCfuucaAfuAfguuuasasu | 1249 | AUUAAACUAUUGAAGGAAAAGGA | 1384 |
| AD-1399879 | usasaaagAfcCfAfUfaaauaaggguL96 | 1115 | asCfscсuUfaUfUfuaugGfuCfuuuuasusu | 1250 | AAUAAAAGACCAUAAAUAAGGGC | 1385 |
| AD-1399880 | asasauaaGfgGfCfGfaaaacauuauL96 | 1116 | asUfsaauGfuUfUfucgcCfcUfuauuusasu | 1251 | AUAAAUAAGGGCGAAAACAUUAC | 1386 |
| AD-1399881 | asasaacaUfuAfCfCfaugugaaaauL96 | 1117 | asUfsuuuCfaCfAfugguAfaUfguuuuscs | 1252 | CGAAAACAUUACCAUGUGAAAAG | 1387 |
| AD-1399882 | asusgugaAfaAfGfAfauguauuucuL96 | 1118 | asGfsaaaUfaCfAfuucuUfuUfcacausgsg | 1253 | CCAUGUGAAAAGAAUGUAUUUCA | 1388 |
| AD-1399883 | asusguauUfuCfAfCfcugcaaguuuL96 | 1119 | asAfsacuUfgCfAfggugAfaAfuacaususc | 1254 | GAAUGUAUUUCACCUGCAAGUUA | 1389 |
| AD-1399884 | asasuaguUfuGfUfGfcauugcaaauL96 | 1120 | asUfsuugCfaAfUfgcacAfaAfcuauususu | 1255 | AAAAUAGUUUGUGCAUUGCAAAU | 1390 |
| AD-1399885 | csasuugcAfaAfUfAfagcaaagacuL96 | 1121 | asGfsucuUfuGfCfuuauUfuGfcaaugscsa | 1256 | UGCAUUGCAAAUAAGCAAAGACU | 1391 |
| AD-1399886 | asgscaaaGfaCfUfUfggauugacuuL96 | 1122 | asAfsgucAfaUfCfcaagUfcUfuugcususa | 1257 | UAAGCAAAGACUUGGAUUGACUU | 1392 |
| AD-1399887 | gsgsauugAfcUfUfUfacauucaucuL96 | 1123 | asGfsaugAfaUfGfuaaaGfuCfaauccsasa | 1258 | UUGGAUUGACUUUACAUUCAUCA | 1393 |
| AD-1399888 | asasugacUfuGfGfUfguguucuuguL96 | 1124 | asCfsaagAfaCfAfcaccAfaGfucauususu | 1259 | AAAAUGACUUGGUGUGUUCUUGU | 1394 |
| AD-1399889 | gsusguucUfuGfUfGfugauuuuuauL96 | 1125 | asUfsaaaAfaUfCfacacAfaGfaacacsasc | 1260 | GUGUGUUCUUGUGUGAUUUUUAC | 1395 |
| AD-1399890 | gscsauauUfuAfAfAfacaugucucuL96 | 1126 | asGfsagaCfaUfGfuu1261uuAfaAfuaugcsasu | 1261 | AUGCAUAUUUAAAACAUGUCUCC | 1396 |
| AD-1399891 | ascsauguCfuCfCfCfuuauuuaccuL96 | 1127 | asGfsguaAfaUfAfagggAfgAfcaugususu | 1262 | AAACAUGUCUCCCUUAUUUACCA | 1397 |
| AD-1399892 | ususauuuAfcCfAfUfauagcaacauL96 | 1128 | asUfsguuGfcUfAfuaugGfuAfaauaasgsg | 1263 | CCUUAUUUACCAUAUAGCAACAU | 1398 |
| AD-1399893 | asusagcaAfcAfUfCfagaauucuguL96 | 1129 | asCfsagaAfuUfCfugauGfuUfgcuaususu | 1264 | AUAUAGCAACAUCAGAAUUCUGA | 1399 |

TABLE 9-continued

Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1399894 | asgsaauuCfuGfAfAfacacaaaauuL96 | 1130 | asAfsuuuUfgUfGfuuucAfgAfauucusgsa | 1265 | UCAGAAUUCUGAAACACAAAAUA | 1400 |
| AD-1399895 | usasugaaAfuAfAfAfuugggagucuL96 | 1131 | asGfsacuCfcCfAfauuuAfuUfucauasusu | 1266 | AAUAUGAAAUAAAUUGGGAGUCA | 1401 |
| AD-1399896 | ususgggaGfuCfAfGfgaauaauuauL96 | 1132 | asUfsaauUfaUfUfccugAfcUfcccaasusu | 1267 | AAUUGGGAGUCAGGAAUAAUUAU | 1402 |

TABLE 10

Additional Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1589130 | gsusgauuAfaAfGfUfauacagugauL96 | 1629 | asUfscacUfgUfAfuacuUfuAfaucacscsu | 1742 | AGGUGAUUAAAGUAUACAGUGAA | 1855 |
| AD-1589133 | asusuaaaGfuAfUfAfcagugaagauL96 | 1630 | asUfscuuCfaCfUfguauAfcUfuuaauscsa | 1743 | UGAUUAAAGUAUACAGUGAAGAU | 1856 |
| AD-1589138 | gsusauacAfgUfGfAfagaugaaacuL96 | 1631 | asGfsuuuCfaUfCfuucaCfuGfuauacsusu | 1744 | AAGUAUACAGUGAAGAUGAAACC | 1857 |
| AD-1589141 | usascaguGfaAfGfAfugaaaccaguL96 | 1632 | asCfsuggUfuUfCfaucuUfcAfcuguasusa | 1745 | UAUACAGUGAAGAUGAAACCAGC | 1858 |
| AD-1589260 | uscsacauAfgGfUfGfuagaaagaauL96 | 1633 | asUfsucuUfuCfUfacacCfuAfugugasgsg | 1746 | CCUCACAUAGGUGUAGAAAGAAC | 1859 |
| AD-1589263 | csasuaggUfgUfAfGfaaagaacaauL96 | 1634 | asUfsuguUfcUfUfucuaCfaCfcuaugsusg | 1747 | CACAUAGGUGUAGAAAGAACAAU | 1860 |
| AD-1589268 | usgsuagaAfaGfAfAfcaauagaaguL96 | 1635 | asCfsuucUfaUfUfguucUfuUfcuacascsc | 1748 | GGUGUAGAAAGAACAAUAGAAGA | 1861 |
| AD-1589270 | asgsaaagAfaCfAfAfuagaagaccuL96 | 1636 | uugUfuCfuuucusascasGfsgucUfuCfUfa | 1749 | GUAGAAAGAACAAUAGAAGACCA | 1862 |
| AD-1589289 | csgsaacuGfgUfGfAfuugaagugcuL96 | 1637 | asGfscacUfuCfAfaucaCfcAfguucgsusg | 1750 | CACGAACUGGUGAUUGAAGUGCU | 1863 |
| AD-1589292 | ascsugguGfaUfUfGfaagugcuauuL96 | 1638 | asAfsuagCfaCfUfucaaUfcAfccagususc | 1751 | GAACUGGUGAUUGAAGUGCUAUC | 1864 |
| AD-1589297 | gsasuugaAfgUfGfCfuauccaacuuL96 | 1639 | asAfsguuGfgAfUfagcaCfuUfcaaucsasc | 1752 | GUGAUUGAAGUGCUAUCCAACUG | 1865 |
| AD-1589302 | asgsaagaAfgAfAfAfcaaacuauuL96 | 1640 | asAfsuagUfuUfGfuuuCfuUfcuucusasu | 1753 | AUAGAAGAAGAAAACAAACUAUA | 1866 |
| AD-1589305 | asgsaagaAfaAfCfAfaacuauacuuL96 | 1641 | asAfsguaUfaGfUfuuguUfuUfcuucususc | 1754 | GAAGAAGAAAACAAACUAUACUU | 1867 |
| AD-1589316 | asusgccaAfaUfAfUfgaguucuuuuL96 | 1642 | asAfsaagAfaCfUfcauaUfuUfggcausasa | 1755 | UUAUGCCAAAUAUGAGUUCUUUA | 1868 |
| AD-1589330 | ususuaaaAfaCfCfCfaauguauuuuL96 | 1643 | asAfsaauAfcAfUfugggUfuUfuuaaasgsa | 1756 | UCUUUAAAAACCCAAUGUAUUUU | 1869 |
| AD-1589333 | ususccagAfgCfAfUfauggauaucuuL96 | 1644 | asAfsgauAfcCfAfuaugCfuCfuggaasasa | 1757 | UUUUCCAGAGCAUAUGGUAUCUU | 1870 |

TABLE 10-continued

Additional Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1589336 | csasgagcAfuAfUfGfguau cuuuuuL96 | 1645 | asAfsaaaGfaUfAfcc auAfuGfcucugsgsa | 1758 | UCCAGAGCAUAU GGUAUCUUUUG | 1871 |
| AD-1589341 | asusauggUfaUfCfUfuuug caacuuL96 | 1646 | asAfsguuGfcAfAfa agaUfaCfcauausgsc | 1759 | GCAUAUGGUAUC UUUUGCAACUG | 1872 |
| AD-1589343 | asusgguaUfcUfUfUfugca acugauL96 | 1647 | asUfscagUfuGfCfaa aaGfaUfaccausasu | 1760 | AUAUGGUAUCUU UUGCAACUGAA | 1873 |
| AD-1589344 | usgsguauCfuUfUfUfgcaa cugaauL96 | 1648 | asUfsucaGfuUfGfca aaAfgAfuaccasusa | 1761 | UAUGGUAUCUUU UGCAACUGAAA | 1874 |
| AD-1589346 | gsusaucuUfuUfGfCfaacu gaaacuL96 | 1649 | asGfsuuuCfaGfUfu gcaAfaAfgauacscsa | 1762 | UGGUAUCUUUUG CAACUGAAACC | 1875 |
| AD-1589351 | ususugcaAfcUfGfAfaacca augguL96 | 1650 | asCfscauUfgGfUfu ucaGfuUfgcaaasasg | 1763 | CUUUUGCAACUG AAACCAAUGGU | 1876 |
| AD-1589354 | gscsaacuGfaAfAfCfcaaug gugauL96 | 1651 | asUfscacCfaUfUfgg uuUfcAfguugcsasa | 1764 | UUGCAACUGAAA CCAAUGGUGAA | 1877 |
| AD-1589365 | asgsauuuUfgCfAfGfaugu uucuguL96 | 1652 | asCfsagaAfaCfAfuc ugCfaAfaaucusgsu | 1765 | ACAGAUUUUGCA GAUGUUUCUGA | 1878 |
| AD-1589368 | ususuugcAfgAfUfGfuuuc ugaguuL96 | 1653 | asAfscucAfgAfAfac auCfuGfcaaaasusc | 1766 | GAUUUUGCAGAU GUUUCUGAGUU | 1879 |
| AD-1589373 | asgsauguUfuCfUfGfaguu caagcuL96 | 1654 | asGfscuuGfaAfCfuc agAfaAfcaucusgsc | 1767 | GCAGAUGUUUCU GAGUUCAAGCA | 1880 |
| AD-1589376 | usgsuuucUfgAfGfUfucaa gcacauL96 | 1655 | asUfsgugCfuUfGfa acuCfaGfaaacasusc | 1768 | GAUGUUUCUGAG UUCAAGCACAU | 1881 |
| AD-1589385 | ususcaagCfaCfAfUfauccu gaaauL96 | 1656 | augUfgCfuugaascsu asUfsuucAfgGfAfu | 1769 | AGUUCAAGCACA UAUCCUGAAAU | 1882 |
| AD-1589388 | asasgcacAfuAfUfCfcugaa auucuL96 | 1657 | asGfsaauUfuCfAfg gauAfuGfugcuusgsa | 1770 | UCAAGCACAUAU CCUGAAAUUCA | 1883 |
| AD-1589393 | asusauccUfgAfAfAfuuca ugguuuL96 | 1658 | asAfsaccAfuGfAfau uuCfaGfgauausgsu | 1771 | ACAUAUCCUGAA AUUCAUGGUUU | 1884 |
| AD-1589395 | asusccugAfaAfUfUfcaug guuucuL96 | 1659 | asGfsaaaCfcAfUfga auUfuCfaggausasu | 1772 | AUAUCCUGAAAU UCAUGGUUUCU | 1885 |
| AD-1589396 | uscscugaAfaUfUfCfaugg uuucuuL96 | 1660 | asAfsgaaAfcCfAfug aaUfuUfcaggasusa | 1773 | UAUCCUGAAAUU CAUGGUUUCUU | 1886 |
| AD-1589398 | csusgaaaUfuCfAfUfgguu cuuauL96 | 1661 | asUfsaagAfaAfCfca ugAfaUfuucagsgsa | 1774 | UCCUGAAAUUCA UGGUUUCUUAC | 1887 |
| AD-1589403 | ususcaugGfuUfUfCfuuac augcguL96 | 1662 | asCfsgcaUfgUfAfag aaAfcCfaugaasusu | 1775 | AAUUCAUGGUUU CUUACAUGCGA | 1888 |
| AD-1589406 | asusgguuUfcUfUfAfcaug cgaaauL96 | 1663 | asUfsuucGfcAfUfg uaaGfaAfaccausgsa | 1776 | UCAUGGUUUCUU ACAUGCGAAAG | 1889 |
| AD-1589471 | cscsgcggCfaUfUfUfgcagu uuuuuL96 | 1664 | asAfsaaaAfcUfGfca aaUfgCfcgcggsusu | 1777 | AACCGCGGCAUU UGCAGUUUUUC | 1890 |
| AD-1589474 | csgsgcauUfuGfCfAfguuu uucaguL96 | 1665 | asCfsugaAfaAfAfcu gcAfaAfugccgscsg | 1778 | CGCGGCAUUUGC AGUUUUUCAGC | 1891 |
| AD-1589479 | ususgcagUfuUfUfUfcagc gaauuuL96 | 1666 | asAfsauuCfgCfUfga aaAfaCfugcaasasu | 1779 | AUUUGCAGUUUU UCAGCGAAUUU | 1892 |
| AD-1589481 | gscsaguuUfuUfCfAfgcga auuuguL96 | 1667 | asCfsaaaUfuCfGfcu gaAfaAfacugcsasa | 1780 | UUGCAGUUUUUC AGCGAAUUUGG | 1893 |
| AD-1589482 | csasguuuUfuCfAfGfcgaa uugguL96 | 1668 | asCfscaaAfuUfCfgc ugAfaAfaacugscsa | 1781 | UGCAGUUUUUCA GCGAAUUUGGC | 1894 |

TABLE 10-continued

Additional Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1589484 | gsusuuuuCfaGfCfGfaauuuggcauL96 | 1669 | asUfsgccAfaAfUfucgcUfgAfaaaacsusg | 1782 | CAGUUUUUCAGCGAAUUUGGCAA | 1895 |
| AD-1589489 | csasgcgaAfuUfUfGfgcaauaguguL96 | 1670 | asCfsacuAfuUfGfccaaAfuUfcgcugsasa | 1783 | UUCAGCGAAUUUGGCAAUAGUGA | 1896 |
| AD-1589492 | csgsaauuUfgGfCfAfauagugauauL96 | 1671 | asUfsaucAfcUfAfuugcCfaAfauucgscsu | 1784 | AGCGAAUUUGGCAAUAGUGAUAU | 1897 |
| AD-1589495 | asusuggCfaAfUfAfgugauauuuuL96 | 1672 | asAfsaauAfuCfAfcuauUfgCfcaaausuc | 1785 | GAAUUUGGCAAUAGUGAUAUUUA | 1898 |
| AD-1589500 | csasauagUfgAfUfAfuuuauguguuL96 | 1673 | asAfscacAfuAfAfauauCfaCfuauugscsc | 1786 | GGCAAUAGUGAUAUUUAUGUGUC | 1899 |
| AD-1589502 | asusagugAfuAfUfUfuaugugucauL96 | 1674 | asUfsgacAfcAfUfaaauAfuCfacuausug | 1787 | CAAUAGUGAUAUUUAUGUGUCAC | 1900 |
| AD-1589503 | usasgugaUfaUfUfUfaugugucacuL96 | 1675 | asGfsugaCfaCfAfuaaaUfaUfcacuasusu | 1788 | AAUAGUGAUAUUUAUGUGUCACU | 1901 |
| AD-1589505 | gsusgauaUfuUfAfUfgugucacuguL96 | 1676 | asCfsaguGfaCfAfcauaAfaUfaucacsusa | 1789 | UAGUGAUAUUUAUGUGUCACUGG | 1902 |
| AD-1589510 | ususuaugUfgUfCfAfcuggcaggcuL96 | 1677 | asGfsccuGfcCfAfgugaCfaCfauaaasusa | 1790 | UAUUUAUGUGUCACUGGCAGGCA | 1903 |
| AD-1589513 | asusguguCfaCfUfGfgcaggcaaauL96 | 1678 | asUfsuugCfcUfGfccagUfgAfcacausasa | 1791 | UUAUGUGUCACUGGCAGGCAAAA | 1904 |
| AD-1589518 | asusggagCfaCfCfGfacuaacuauuL96 | 1679 | asAfsuagUfuAfGfucggUfgCfuccausgsu | 1792 | ACAUGGAGCACCGACUAACUAUG | 1905 |
| AD-1589520 | gsgsagcaCfcGfAfCfuaacuaugguL96 | 1680 | asCfscauAfgUfUfagucGfgUfgcuccsasu | 1793 | AUGGAGCACCGACUAACUAUGGA | 1906 |
| AD-1589521 | gsasgcacCfgAfCfUfaacuauggauL96 | 1681 | asUfsccaUfaGfUfuaguCfgGfugcucscsa | 1794 | UGGAGCACCGACUAACUAUGGAU | 1907 |
| AD-1589523 | gscsaccgAfcUfAfAfcuauggauuuL96 | 1682 | asAfsaucCfaUfAfguuaGfuCfggugcsusc | 1795 | GAGCACCGACUAACUAUGGAUUC | 1908 |
| AD-1589528 | ascsuaacUfaUfGfGfauucugcuuuL96 | 1683 | asAfsagcAfgAfAfuccaUfaGfuuaguscsg | 1796 | CGACUAACUAUGGAUUCUGCUUU | 1909 |
| AD-1589531 | asascuauGfgAfUfUfcugcuuuaauL96 | 1684 | asUfsuaaAfgCfAfgaauCfcAfuaguusasg | 1797 | CUAACUAUGGAUUCUGCUUUAAG | 1910 |
| AD-1589625 | usgscagcUfgUfAfCfcagaauuauuL96 | 1685 | asAfsuaaUfuCfUfgguaCfaGfcugcasusg | 1798 | CAUGCAGCUGUACCAGAAUUAUA | 1911 |
| AD-1589628 | asgscuguAfcCfAfGfaauuauauguL96 | 1686 | asCfsauaUfaAfUfucugGfuAfcagcusgsc | 1799 | GCAGCUGUACCAGAAUUAUAUGC | 1912 |
| AD-1589633 | ascscagaAfuUfAfUfaugcauccauL96 | 1687 | asUfsggaUfgCfAfuauaAfuUfcuggusasc | 1800 | GUACCAGAAUUAUAUGCAUCCAU | 1913 |
| AD-1589636 | asgsaauuAfuAfUfGfcauccauauuL96 | 1688 | asAfsuauGfgAfUfgcauAfuAfauucusgsg | 1801 | CCAGAAUUAUAUGCAUCCAUAUC | 1914 |
| AD-1589665 | gsgscugcAfgUfUfCfacagagcauuL96 | 1689 | asAfsugcUfcUfGfugaaCfuGfcagccsasc | 1802 | GUGGCUGCAGUUCACAGAGCAUA | 1915 |
| AD-1589668 | usgscaguUfcAfCfAfgagcauaucuL96 | 1690 | asGfsauaUfgCfUfcuguGfaAfcugcasgsc | 1803 | GCUGCAGUUCACAGAGCAUAUCA | 1916 |
| AD-1589673 | uscsacagAfgCfAfUfaucaccuauuL96 | 1691 | asAfsuagGfuGfAfuaugCfuCfugugasasc | 1804 | GUUCACAGAGCAUAUCACCUAUG | 1917 |

TABLE 10-continued

Additional Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1589676 | csasgagcAfuAfUfCfaccuaugaguL96 | 1692 | asCfsucaUfaGfGfugauAfuGfcucugsusg | 1805 | CACAGAGCAUAUCACCUAUGAGA | 1918 |
| AD-1589685 | csasccuaUfgAfGfAfaguauaucauL96 | 1693 | asUfsgauAfuAfCfuucuCfaUfaggugsasu | 1806 | AUCACCUAUGAGAAGUAUAUCAG | 1919 |
| AD-1589688 | csusaugaGfaAfGfUfauaucagaguL96 | 1694 | asCfsucuGfaUfAfuacuUfcUfcauagsgsu | 1807 | ACCUAUGAGAAGUAUAUCAGAGA | 1920 |
| AD-1589693 | gsasaguaUfaUfCfAfgagaauuccuL96 | 1695 | asGfsgaaUfuCfUfcugaUfaUfacuucsusc | 1808 | GAGAAGUAUAUCAGAGAAUUCCC | 1921 |
| AD-1589695 | asgsuauaUfcAfGfAfgaauucccuuL96 | 1696 | asAfsgggAfaUfUfcucuGfaUfauacususc | 1809 | GAAGUAUAUCAGAGAAUUCCCUG | 1922 |
| AD-1589696 | gsusauauCfaGfAfGfaauucccuguL96 | 1697 | asCfsaggGfaAfUfucucUfgAfuauacsusu | 1810 | AAGUAUAUCAGAGAAUUCCCUGG | 1923 |
| AD-1589698 | asusaucaGfaGfAfAfuucccugguuL96 | 1698 | asAfsccaGfgGfAfauucUfcUfgauausasc | 1811 | GUAUAUCAGAGAAUUCCCUGGUA | 1924 |
| AD-1589703 | gsasgaauUfcCfCfUfgguagcaauuL96 | 1699 | asAfsuugCfuAfCfcaggGfaAfuucucsusg | 1812 | CAGAGAAUUCCCUGGUAGCAAUG | 1925 |
| AD-1589705 | gsasauucCfcUfGfGfuagcaauugguL96 | 1700 | asCfscauUfgCfUfaccaGfgGfaauucsusc | 1813 | GAGAAUUCCCUGGUAGCAAUGGA | 1926 |
| AD-1589706 | asasuuccCfuGfGfUfagcaauggauL96 | 1701 | asUfsccaUfuGfCfuaccAfgGfgaauuscsu | 1814 | AGAAUUCCCUGGUAGCAAUGGAC | 1927 |
| AD-1589708 | ususcccuGfgUfAfGfcaauggacuuL96 | 1702 | asAfsgucCfaUfUfgcuaCfcAfgggaasusu | 1815 | AAUUCCCUGGUAGCAAUGGACUU | 1928 |
| AD-1589713 | gsgsuagcAfaUfGfGfacuucucaguL96 | 1703 | asCfsugaGfaAfGfuccaUfuGfcuaccsasg | 1816 | CUGGUAGCAAUGGACUUCUCAGG | 1929 |
| AD-1589716 | asgscaauGfgAfCfUfucucaggccuL96 | 1704 | asGfsgccUfgAfGfaaguCfcAfuugcusasc | 1817 | GUAGCAAUGGACUUCUCAGGCCA | 1930 |
| AD-1589842 | csasgccaUfgGfUfUfucaccacaauL96 | 1705 | asUfsuguGfgUfGfaaacCfaUfggcugsgsg | 1818 | CCCAGCCAUGGUUUCACCACAAA | 1931 |
| AD-1589845 | cscsauggUfuUfCfAfccacaaaauuL96 | 1706 | asAfsuuuUfgUfGfgugaAfaCfcauggscsu | 1819 | AGCCAUGGUUUCACCACAAAAUU | 1932 |
| AD-1589850 | ususucacCfaCfAfAfaauuucuaguL96 | 1707 | asCfsuagAfaAfUfuuugUfgGfugaaascsc | 1820 | GGUUUCACCACAAAAUUUCUAGA | 1933 |
| AD-1589853 | csasccacAfaAfAfUfuucuagagauL96 | 1708 | asUfscucUfaGfAfaauuUfuGfuggugsasa | 1821 | UUCACCACAAAAUUUCUAGAGAU | 1934 |
| AD-1589902 | gsusggauGfgAfGfUfuuucuugguuL96 | 1709 | asAfsccaAfgAfAfaacuCfcAfuccacsasa | 1822 | UUGUGGAUGGAGUUUUCUUGGUA | 1935 |
| AD-1589905 | gsasuggaGfuUfUfUfcuugguacguL96 | 1710 | asCfsguaCfcAfAfgaaaAfcUfccaucscsa | 1823 | UGGAUGGAGUUUUCUUGGUACGG | 1936 |
| AD-1589910 | gsusuuucUfuGfGfUfacgggauaguL96 | 1711 | asCfsuauCfcCfGfuaccAfaGfaaaacsusc | 1824 | GAGUUUUCUUGGUACGGGAUAGU | 1937 |
| AD-1589913 | ususcuugGfuAfCfGfggauagucauL96 | 1712 | asUfsgacUfaUfCfccguAfcCfaagaasasa | 1825 | UUUUCUUGGUACGGGAUAGUCAG | 1938 |
| AD-1589923 | asascuuuCfgUfAfCfugucaaugauL96 | 1713 | asUfscauUfgAfCfaguaCfgAfaaguusis u | 1826 | AAAACUUUCGUACUGUCAAUGAG | 1939 |
| AD-1589925 | csusuucgUfaCfUfGfucaaugaguuL96 | 1714 | asAfscucAfuUfGfacagUfaCfgaaagsusu | 1827 | AACUUUCGUACUGUCAAUGAGUC | 1940 |
| AD-1589926 | ususucguAfcUfGfUfcaaugagucuL96 | 1715 | asGfsacuCfaUfUfgacaGfuAfcgaaasgsu | 1828 | ACUUUCGUACUGUCAAUGAGUCA | 1941 |

TABLE 10-continued

Additional Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1589928 | uscsguacUfgUfCfAfaugagucauuL96 | 1716 | asAfsugaCfuCfAfuugaCfaGfuacgasasa | 1829 | UUUCGUACUGUCAAUGAGUCAUG | 1942 |
| AD-1589933 | usgsucaaUfgAfGfUfcauggacaauL96 | 1717 | asUfsuguCfcAfUfgacuCfaUfugacasgsu | 1830 | ACUGUCAAUGAGUCAUGGACAAA | 1943 |
| AD-1590015 | usasauacAfgCfUfGfguggaguucuL96 | 1718 | asGfsaacUfcCfAfccagCfuGfuauuasgsa | 1831 | UCUAAUACAGCUGGUGGAGUUCU | 1944 |
| AD-1590018 | usascagcUfgGfUfGfgaguucuauuL96 | 1719 | asAfsuagAfaCfUfccacCfaGfcuguasusu | 1832 | AAUACAGCUGGUGGAGUUCUAUC | 1945 |
| AD-1590023 | usgsguggAfgUfUfCfuaucaacucuL96 | 1720 | asGfsaguUfgAfUfagaaCfuCfcaccasgsc | 1833 | GCUGGUGGAGUUCUAUCAACUCA | 1946 |
| AD-1590026 | usgsgaguUfcUfAfUfcaacucaauuL96 | 1721 | asAfsuugAfgUfUfgauaGfaAfcuccascsc | 1834 | GGUGGAGUUCUAUCAACUCAAUA | 1947 |
| AD-1590045 | asgsggcgUfuCfUfUfccuugcaaguL96 | 1722 | asCfsuugCfaAfGfgaagAfaCfgcccus2usa | 1835 | UAAGGGCGUUCUUCCUUGCAAGU | 194 |
| AD-1590048 | gscsguucUfuCfCfUfugcaaguuguL96 | 1723 | asCfsaacUfuGfCfaaggAfaGfaacgcscsc | 1836 | GGGCGUUCUUCCUUGCAAGUUGA | 1949 |
| AD-1590053 | ususccuuGfcAfAfGfuugaaacauuL96 | 1724 | asAfsuguUfuCfAfacuuGfcAfaggaasgsa | 1837 | UCUUCCUUGCAAGUUGAAACAUU | 1950 |
| AD-1590056 | csusugcaAfgUfUfGfaaacauuauuL96 | 1725 | asAfsuaaUfgUfUfucaaCfuUfgcaagsgsa | 1838 | UCCUUGCAAGUUGAAACAUUAUU | 1951 |
| AD-1590085 | gscsucucUfaGfAfCfaagccagaauL96 | 1726 | asUfsucuGfgCfUfugucUfaGfagagcsasa | 1839 | UUGCUCUCUAGACAAGCCAGAAG | 1952 |
| AD-1590088 | csuscuagAfcAfAfGfccagaaguguL96 | 1727 | asCfsacuUfcUfGfgcuuGfuCfuagagsasg | 1840 | CUCUCUAGACAAGCCAGAAGUGA | 1953 |
| AD-1590093 | ascsaagcCfaGfAfAfgugacuuauuL96 | 1728 | asAfsuaaGfuCfAfcuucUfgGfcuuguscsu | 1841 | AGACAAGCCAGAAGUGACUUAUU | 1954 |
| AD-1590096 | asgsccagAfaGfUfGfacuuauuaauL96 | 1729 | asUfsuaaUfaAfGfucacUfuCfuggcusgsg | 1842 | CAAGCCAGAAGUGACUUAUUAAA | 1955 |
| AD-1590145 | asgsggcgAfaAfAfCfauuaccauguL96 | 1730 | asCfsaugGfuAfAfuguuUfuCfgcccusgsa | 1843 | UAAGGGCGAAAACAUUACCAUGU | 1956 |
| AD-1590148 | gscsgaaaAfcAfUfUfaccaugugauL96 | 1731 | asUfscacAfuGfGfuaauGfuUfuucgcscsc | 1844 | GGGCGAAAACAUUACCAUGUGAA | 1957 |
| AD-1590153 | ascsauuaCfcAfUfGfugaaaagaauL96 | 1732 | asUfsucuUfuUfCfacauGfgUfaaugusgsu | 1845 | AAACAUUACCAUGUGAAAAGAAU | 1958 |
| AD-1590155 | asusuaccAfuGfUfGfaaaagaauguL96 | 1733 | asCfsauuCfuUfUfucacAfuGfguaausgsu | 1846 | ACAUUACCAUGUGAAAAGAAUGU | 1959 |
| AD-1590156 | ususaccaUfgUfGfAfaaagaauguuL96 | 1734 | asAfscauUfcUfUfuucaCfaUfgguaasusg | 1847 | CAUUACCAUGUGAAAAGAAUGUA | 1960 |
| AD-1590158 | ascscaugUfgAfAfAfagaauguauuL96 | 1735 | asAfsuacAfuUfCfuuuuCfaCfauggusasa | 1848 | UUACCAUGUGAAAAGAAUGUAUU | 1961 |
| AD-1590163 | usgsaaaaGfaAfUfGfuauuucaccuL96 | 1736 | asGfsgugAfaAfUfacauUfcUfuuucascsa | 1849 | UGUGAAAAGAAUGUAUUUCACCU | 1962 |
| AD-1590166 | asasagaaUfgUfAfUfuucaccugcuL96 | 1737 | asGfscagGfuGfAfaauaCfaUfucuuusc | 1850 | GAAAAGAAUGUAUUUCACCUGCA | 1963 |
| AD-1590192 | csasaauaAfgCfAfAfagacuuggauL96 | 1738 | asUfsccaAfgUfCfuuugCfuUfauuugscsa | 1851 | UGCAAAUAAGCAAAGACUUGGAU | 1964 |
| AD-1590195 | asusaagcAfaAfGfAfcuuggauuguL96 | 1739 | asCfsaauCfcAfAfgucuUfuGfcuuausus u | 1852 | AAAUAAGCAAAGACUUGGAUUGA | 1965 |

TABLE 10-continued

Additional Human Modified Sense and Antisense Strand Sequences of GRB14 dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1590200 | asasagacUfuGfGfAfuugacuuuauL96 | 1740 | asUfsaaaGfuCfAfauccAfaGfucuuusgsc | 1853 | GCAAAGACUUGGAUUGACUUUAC | 1966 |
| AD-1590203 | gsascuugGfaUfUfGfacuuuacauuL96 | 1741 | asAfsuguAfaAfGfucaaUfcCfaagucsusu | 1854 | AAGACUUGGAUUGACUUUACAUU | 1967 |
| AD-1631258 | usgsaaguGfcUfAfUfccaacuggguL96 | 2671 | asCfsccaGfuUfGfgauaGfcAfcuucasasu | 2685 | AUUGAAGUGCUAUCCAACUGGGG | 2699 |
| AD-1631259 | csusggggGfaUfAfGfaagaagaaauL96 | 2672 | asUfsuucUfuCfUfucuaUfcCfcccagsusu | 2686 | AACUGGGGGAUAGAAGAAGAAAA | 2700 |
| AD-1631260 | gsgsggauAfgAfAfGfaagaaaacauL96 | 2673 | asUfsguuUfuCfUfucuuCfuAfuccccscsa | 2687 | UGGGGGAUAGAAGAAGAAAACAA | 2701 |
| AD-1631261 | gsasaaaaAfuUfAfUfgccaaauauuL96 | 2674 | asAfsuauUfuGfGfcauaAfuUfuuuucsusa | 2688 | UAGAAAAAAUUAUGCCAAAUAUG | 2702 |
| AD-1631262 | asasaauuAfuGfCfCfaaauaugaguL96 | 2675 | asCfsucaUfaUfUfuggcAfuAfauuuususu | 2689 | AAAAAAUUAUGCCAAAUAUGAGU | 2703 |
| AD-1631263 | cscsaaauAfuGfAfGfuucuuuaaauL96 | 2676 | asUfsuuaAfaGfAfacucAfuAfuuuggscsa | 2690 | UGCCAAAUAUGAGUUCUUUAAAA | 2704 |
| AD-1631264 | asasaaacCfcAfAfUfguauuuuuuL96 | 2677 | asAfsaaaAfaUfAfcauuGfgGfuuuuusasa | 2691 | UUAAAAACCCAAUGUAUUUUUUU | 2705 |
| AD-1631265 | cscsaaugUfaUfUfUfuuuuccagauL96 | 2678 | asUfscugGfaAfAfaaaaUfaCfauuggsgsu | 2692 | ACCCAAUGUAUUUUUUUCCAGAG | 2706 |
| AD-1631266 | asusguauUfuUfUfUfuccagagcauL96 | 2679 | asUfsgcuCfuGfGfaaaAfaAfuacausug | 2693 | CAAUGUAUUUUUUUCCAGAGCAU | 2707 |
| AD-1631267 | asasaaaaAfaCfAfUfggagcaccguL96 | 2680 | asCfsgguGfcUfCfcaugUfuUfuuuuusug | 2694 | CAAAAAAAAACAUGGAGCACCGA | 2708 |
| AD-1631268 | asasaaacAfuGfGfAfgcaccgacuuL96 | 2681 | asAfsgucGfgUfGfcuccAfuGfuuuuusus u | 2695 | AAAAAAACAUGGAGCACCGACUA | 2709 |
| AD-1631269 | usasacccCfaAfAfAfcuucguacuL96 | 2682 | asGfsuacGfaAfAfguuuUfgGfgguuascs u | 2696 | AGUAACCCCAAAACUUUCGUACU | 2710 |
| AD-1631270 | cscsccaaAfaCfUfUfucguacuguuL96 | 2683 | asAfscagUfaCfGfaaagUfuUfuggggsusu | 2697 | AACCCCAAAACUUUCGUACUGUC | 2711 |
| AD-1631271 | csasaugaGfuCfAfUfggacaaaaauL96 | 2684 | asUfsuuuUfgUfCfcaugAfcUfcauugsasc | 2698 | GUCAAUGAGUCAUGGACAAAAAA | 2712 |

Example 2. In Vitro Screening Methods

In vitro Cos-7 (Dual-Luciferase psiCHECK2 vector), Primary Human Hepatocytes, and Primary Cynomolgus Hepatocytes screening Cell Culture and Transfections:

Hep3B cells (ATCC, Manassas, VA) were grown to near confluence at 37° C. in an atmosphere of 5% CO2 in Eagle's Minimum Essential Medium (Gibco) supplemented with 10% FBS (ATCC) before being released from the plate by trypsinization. Transfection was carried out by adding 14.7 µl of Opti-MEM plus 0.3 µl of Lipofectamine™ RNAiMax per well (Invitrogen, Carlsbad CA. cat #13778-150) to 5 µl of each siRNA duplex to an individual well in a 96-well plate with 4 replicates of each siRNA duplex. The mixture was then incubated at room temperature for 15 minutes. Eighty µl of complete growth media without antibiotic containing ~$1.5\times10^4$ Hep3B cells were then added to the siRNA mixture. Cells were incubated for 24 hours prior to RNA purification. Single dose experiments were performed at 10 nM final duplex concentration.

Cos-7 (ATCC) are transfected by adding 5 µl of 1 ng/µl, diluted in Opti-MEM, GRB10 or GRB14 psiCHECK2 vector (Blue Heron Biotechnology), 4.9 µl of Opti-MEM plus 0.1 µl of Lipofectamine™ 2000 per well (Invitrogen, Carlsbad CA. cat #11668-019) to 5 µl of siRNA duplexes per well, with 4 replicates of each siRNA duplex, into a 384-well plate, and incubated at room temperature for 15 minutes. Thirty-five µl of Dulbecco's Modified Eagle Medium (ThermoFisher) containing ~$5\times10^3$ cells are then added to the siRNA mixture. Cells are incubated for 48 hours followed by Firefly (transfection control) and *Renilla* (fused to target sequence) luciferase measurements. Single dose experiments are performed at 50 nM, 10 nM, InM, and 0.1 nM.

Primary Human Hepatocytes (BioIVT) are transfected by adding 4.9 µl of Opti-MEM plus 0.1 µl of RNAiMAX per well (Invitrogen, Carlsbad CA. cat #13778-150) to 5 µl of siRNA duplexes per well, with 4 replicates of each siRNA duplex, into a 384-well plate, and incubated at room temperature for 15 minutes. Thirty-five µl of InVitroGRO CP plating media (BioIVT) containing ~15×10$^3$ cells are then added to the siRNA mixture. Cells are incubated for 48 hours prior to RNA purification. Single dose experiments are performed at 50 nM.

Primary Cynomolgus Hepatocytes (BioIVT) are transfected by adding 4.9 µl of Opti-MEM plus 0.1 µl of RNAiMAX per well (Invitrogen, Carlsbad CA. cat #13778-150) to 5 µl of siRNA duplexes per well, with 4 replicates of each siRNA duplex, into a 384-well plate, and incubated at room temperature for 15 minutes. Thirty-five µl of InVitroGRO CP plating media (BioIVT) containing ~5×10$^3$ cells are then added to the siRNA mixture. Cells were incubated for 48 hours prior to RNA purification. Single dose experiments are performed at 50 nM.

Total RNA isolation using DYNABEADS™ mRNA Isolation Kit:

RNA is isolated using an automated protocol on a BioTek-EL406 platform using DYNABEADS™ (Invitrogen, cat #61012). Briefly, 70ul of Lysis/Binding Buffer and 10ul of lysis buffer containing 3 µl of magnetic beads are added to the plate with cells. Plates were incubated on an electromagnetic shaker for 10 minutes at room temperature and then magnetic beads are captured and the supernatant is removed. Bead-bound RNA is then washed 2 times with 150ul Wash Buffer A and once with Wash Buffer B. Beads are then washed with 150 µl Elution Buffer, re-captured and supernatant removed.

cDNA Synthesis Using ABI High Capacity cDNA Reverse Transcription Kit (Applied Biosystems, Foster City, CA, Cat #4368813):

Ten µl of a master mix containing 1 µl 10× Buffer, 0.4 µl 25×dNTPs, 1 µl 10× Random primers, 0.5 µl Reverse Transcriptase, 0.5 µl RNase inhibitor and 6.6 µl of $H_2O$ per reaction are added to RNA isolated above. Plates are sealed, mixed, and incubated on an electromagnetic shaker for 10 minutes at room temperature, followed by 2 h at 37° C.

Real time PCR:

Two µl of cDNA and 5 µl Lightcycler 480 probe master mix (Roche Cat #04887301001) are added to 0.5 µl of Human GAPDH TaqMan™ Probe (4326317E) and 0.5 µl GRB10 Human probe (Hs00959286_ml, Thermo), 0.5 µl of Human GAPDH TaqMan™ Probe (4326317E) and 0.5 µl GRB14 Human probe (Hs00182949_ml, Thermo), 0.5 µl Cyno GAPDH (custom) and 0.5 µl GRB10 Cyno probe, or 0.5 µl Cyno GAPDH (custom) and 0.5 µl GRB14 Cyno probe per well in a 384 well plates (Roche cat #04887301001). Real time PCR is done in a LightCycler480 Real Time PCR system (Roche). Each duplex is tested at least two times and data are normalized to cells transfected with a non-targeting control siRNA. To calculate relative fold change, real time data is analyzed using the ΔΔCt method and normalized to assays performed with cells transfected with a non-targeting control siRNA.

Results

The results of the single dose screen in Hep3B cells with exemplary human GRB14 siRNAs are shown in Table 11. The experiments were performed at 10 nM final duplex concentrations and the data are expressed as percent GRB14 mRNA remaining relative to non-targeting control (GAPDH).

TABLE 11

In vitro screen of human GRB14 siRNA in Hep3B cells

| | 10 nM Dose | |
|---|---|---|
| Duplex | Avg % mRNA Remaining | SD |
| AD-1399762.1 | 70.49 | 10.37 |
| AD-1399763.1 | 62.21 | 11.17 |
| AD-1399764.1 | 71.65 | 8.67 |
| AD-1399765.1 | 62.05 | 8.69 |
| AD-1399766.1 | 69.04 | 4.67 |
| AD-1399767.1 | 55.02 | 2.63 |
| AD-1399768.1 | 57.26 | 2.12 |
| AD-1399769.1 | 50.35 | 3.60 |
| AD-1399770.1 | 57.27 | 4.53 |
| AD-1399771.1 | 56.68 | 5.59 |
| AD-1399772.1 | 55.96 | 3.41 |
| AD-1399773.1 | 51.85 | 5.68 |
| AD-1399774.1 | 53.68 | 3.68 |
| AD-1399775.1 | 48.36 | 15.62 |
| AD-1399776.1 | 36.19 | 2.11 |
| AD-1399776.2 | 38.54 | 7.67 |
| AD-1399777.1 | 64.29 | 3.86 |
| AD-1399778.1 | 43.03 | 4.74 |
| AD-1399779.1 | 44.93 | 4.63 |
| AD-1399780.1 | 56.11 | 4.83 |
| AD-1399781.1 | 41.85 | 3.35 |
| AD-1399782.1 | 40.87 | 1.63 |
| AD-1399783.1 | 49.06 | 3.78 |
| AD-1399784.1 | 47.80 | 11.38 |
| AD-1399785.1 | 51.30 | 3.02 |
| AD-1399786.1 | 45.29 | 4.48 |
| AD-1399787.1 | 45.57 | 3.11 |
| AD-1399788.1 | 40.62 | 4.01 |
| AD-1399789.1 | 39.42 | 3.92 |
| AD-1399789.2 | 48.85 | 1.46 |
| AD-1399790.1 | 45.60 | 1.83 |
| AD-1399791.1 | 44.11 | 1.79 |
| AD-1399792.1 | 36.09 | 1.05 |
| AD-1399792.2 | 48.04 | 4.00 |
| AD-1399793.1 | 30.48 | 2.04 |
| AD-1399793.2 | 30.71 | 3.32 |
| AD-1399794.1 | 30.76 | 5.63 |
| AD-1399794.2 | 43.48 | 1.99 |
| AD-1399795.1 | 35.05 | 6.73 |
| AD-1399795.2 | 42.05 | 1.39 |
| AD-1399796.1 | 62.47 | 8.14 |
| AD-1399797.1 | 35.65 | 2.00 |
| AD-1399797.2 | 36.52 | 0.96 |
| AD-1399798.1 | 38.50 | 1.80 |
| AD-1399798.2 | 37.16 | 2.49 |
| AD-1399799.1 | 47.30 | 1.21 |
| AD-1399800.1 | 41.39 | 2.53 |
| AD-1399801.1 | 37.81 | 0.75 |
| AD-1399801.2 | 40.06 | 2.08 |
| AD-1399802.1 | 45.23 | 1.06 |
| AD-1399803.1 | 36.95 | 1.03 |
| AD-1399803.2 | 40.93 | 2.80 |
| AD-1399804.1 | 28.80 | 1.04 |
| AD-1399804.2 | 31.51 | 4.72 |
| AD-1399805.1 | 45.84 | 8.27 |
| AD-1399806.1 | 59.28 | 3.92 |
| AD-1399807.1 | 56.73 | 1.40 |
| AD-1399808.1 | 50.36 | 2.01 |
| AD-1399809.1 | 57.83 | 0.61 |
| AD-1399810.1 | 48.68 | 3.25 |
| AD-1399811.1 | 43.87 | 3.28 |
| AD-1399812.1 | 37.10 | 1.33 |
| AD-1399812.2 | 45.79 | 2.14 |
| AD-1399813.1 | 32.37 | 2.91 |
| AD-1399813.2 | 39.13 | 3.04 |
| AD-1399814.1 | 33.60 | 4.05 |
| AD-1399814.2 | 39.06 | 1.99 |
| AD-1399815.1 | 39.86 | 1.57 |
| AD-1399815.2 | 40.34 | 9.03 |
| AD-1399816.1 | 36.11 | 2.26 |
| AD-1399816.2 | 42.06 | 1.57 |
| AD-1399817.1 | 39.86 | 0.95 |
| AD-1399817.2 | 42.10 | 1.25 |
| AD-1399818.1 | 42.99 | 2.20 |

TABLE 11-continued

In vitro screen of human GRB14 siRNA in Hep3B cells

| | 10 nM Dose | |
|---|---|---|
| Duplex | Avg % mRNA Remaining | SD |
| AD-1399819.1 | 69.93 | 2.53 |
| AD-1399820.1 | 41.99 | 0.91 |
| AD-1399821.1 | 56.99 | 2.91 |
| AD-1399822.1 | 49.18 | 2.39 |
| AD-1399823.1 | 68.17 | 6.31 |
| AD-1399824.1 | 50.60 | 1.68 |
| AD-1399825.1 | 70.15 | 24.37 |
| AD-1399826.1 | 42.71 | 1.76 |
| AD-1399827.1 | 42.36 | 1.28 |
| AD-1399828.1 | 26.90 | 0.53 |
| AD-1399828.2 | 23.54 | 0.45 |
| AD-1399829.1 | 45.13 | 1.36 |
| AD-1399830.1 | 52.50 | 2.62 |
| AD-1399831.1 | 48.64 | 1.09 |
| AD-1399832.1 | 38.28 | 1.47 |
| AD-1399832.2 | 48.27 | 1.04 |
| AD-1399833.1 | 44.04 | 1.91 |
| AD-1399834.1 | 33.62 | 1.68 |
| AD-1399834.2 | 36.76 | 1.56 |
| AD-1399835.1 | 39.28 | 2.35 |
| AD-1399835.2 | 48.02 | 2.44 |
| AD-1399836.1 | 34.53 | 1.26 |
| AD-1399836.2 | 39.03 | 0.81 |
| AD-1399837.1 | 74.49 | 9.30 |
| AD-1399838.1 | 42.20 | 6.75 |
| AD-1399839.1 | 43.23 | 6.13 |
| AD-1399840.1 | 56.18 | 6.22 |
| AD-1399841.1 | 46.72 | 7.07 |
| AD-1399842.1 | 53.75 | 5.19 |
| AD-1399843.1 | 55.40 | 6.74 |
| AD-1399844.1 | 62.93 | 7.71 |
| AD-1399845.1 | 61.95 | 7.64 |
| AD-1399846.1 | 45.96 | 3.93 |
| AD-1399847.1 | 43.20 | 5.18 |
| AD-1399848.1 | 42.09 | 2.49 |
| AD-1399849.1 | 78.17 | 7.82 |
| AD-1399850.1 | 46.21 | 5.23 |
| AD-1399851.1 | 32.48 | 3.00 |
| AD-1399851.2 | 42.17 | 3.89 |
| AD-1399852.1 | 40.85 | 4.32 |
| AD-1399853.1 | 40.42 | 3.98 |
| AD-1399854.1 | 43.21 | 5.90 |
| AD-1399855.1 | 67.12 | 7.96 |
| AD-1399856.1 | 42.10 | 5.49 |
| AD-1399857.1 | 38.15 | 2.39 |
| AD-1399857.2 | 46.74 | 0.99 |
| AD-1399858.1 | 46.00 | 7.50 |
| AD-1399859.1 | 33.30 | 4.52 |
| AD-1399859.2 | 32.47 | 6.03 |
| AD-1399860.1 | 40.00 | 2.64 |
| AD-1399860.2 | 46.96 | 2.22 |
| AD-1399861.1 | 40.30 | 2.94 |
| AD-1399862.1 | 46.69 | 6.74 |
| AD-1399863.1 | 45.32 | 2.17 |
| AD-1399864.1 | 43.22 | 3.47 |
| AD-1399865.1 | 44.37 | 2.24 |
| AD-1399866.1 | 45.11 | 2.62 |
| AD-1399867.1 | 42.37 | 5.15 |
| AD-1399868.1 | 44.88 | 4.21 |
| AD-1399869.1 | 38.55 | 4.93 |
| AD-1399869.2 | 43.13 | 0.70 |
| AD-1399870.1 | 41.76 | 2.00 |
| AD-1399871.1 | 40.19 | 6.81 |
| AD-1399872.1 | 34.53 | 4.33 |
| AD-1399872.2 | 37.14 | 0.74 |
| AD-1399873.1 | 43.15 | 5.04 |
| AD-1399874.1 | 40.10 | 3.25 |
| AD-1399875.1 | 51.51 | 13.36 |
| AD-1399876.1 | 37.45 | 2.49 |
| AD-1399876.2 | 38.12 | 0.93 |
| AD-1399877.1 | 43.01 | 3.73 |
| AD-1399878.1 | 45.47 | 6.92 |
| AD-1399879.1 | 60.63 | 6.36 |
| AD-1399880.1 | 51.76 | 9.71 |
| AD-1399881.1 | 34.79 | 6.99 |
| AD-1399881.2 | 40.85 | 0.88 |
| AD-1399882.1 | 35.10 | 3.18 |
| AD-1399882.2 | 34.38 | 2.15 |
| AD-1399883.1 | 42.14 | 2.25 |
| AD-1399884.1 | 51.58 | 2.88 |
| AD-1399885.1 | 43.12 | 3.19 |
| AD-1399886.1 | 39.84 | 3.13 |
| AD-1399886.2 | 34.60 | 1.33 |
| AD-1399887.1 | 43.95 | 3.79 |
| AD-1399888.1 | 89.51 | 5.38 |
| AD-1399889.1 | 92.54 | 3.79 |
| AD-1399890.1 | 93.91 | 2.14 |
| AD-1399891.1 | 86.03 | 8.21 |
| AD-1399892.1 | 91.14 | 1.73 |
| AD-1399893.1 | 96.20 | 5.08 |
| AD-1399894.1 | 94.35 | 2.61 |
| AD-1399895.1 | 83.95 | 13.98 |
| AD-1399896.1 | 96.70 | 4.26 |
| AD-1589130.1 | 52.5 | 1.84 |
| AD-1589133.1 | 50.80 | 2.74 |
| AD-1589138.1 | 45.50 | 1.93 |
| AD-1589141.1 | 47.94 | 8.04 |
| AD-1589260.1 | 42.78 | 1.96 |
| AD-1589263.1 | 44.83 | 0.64 |
| AD-1589268.1 | 48.43 | 2.05 |
| AD-1589270.1 | 46.77 | 5.05 |
| AD-1589289.1 | 53.21 | 4.11 |
| AD-1589292.1 | 46.70 | 1.64 |
| AD-1589297.1 | 59.11 | 10.33 |
| AD-1589302.1 | 32.07 | 1.39 |
| AD-1589305.1 | 27.99 | 7.00 |
| AD-1589316.1 | 33.42 | 1.55 |
| AD-1589330.1 | 47.61 | 15.25 |
| AD-1589333.1 | 28.09 | 2.11 |
| AD-1589336.1 | 70.25 | 1.88 |
| AD-1589341.1 | 26.24 | 7.85 |
| AD-1589343.1 | 37.72 | 1.22 |
| AD-1589344.1 | 39.63 | 2.42 |
| AD-1589346.1 | 43.60 | 5.50 |
| AD-1589351.1 | 70.01 | 3.33 |
| AD-1589354.1 | 51.72 | 2.69 |
| AD-1589365.1 | 33.96 | 1.53 |
| AD-1589368.1 | 46.53 | 2.14 |
| AD-1589373.1 | 46.67 | 3.25 |
| AD-1589376.1 | 40.49 | 2.19 |
| AD-1589385.1 | 43.16 | 2.24 |
| AD-1589388.1 | 40.79 | 1.78 |
| AD-1589393.1 | 28.57 | 1.95 |
| AD-1589395.1 | 29.76 | 2.08 |
| AD-1589396.1 | 32.93 | 1.03 |
| AD-1589398.1 | 37.34 | 0.50 |
| AD-1589403.1 | 46.30 | 3.11 |
| AD-1589406.1 | 45.05 | 5.53 |
| AD-1589471.1 | 51.87 | 5.28 |
| AD-1589474.1 | 46.87 | 2.75 |
| AD-1589479.1 | 30.71 | 4.77 |
| AD-1589481.1 | 46.98 | 3.88 |
| AD-1589482.1 | 47.86 | 3.54 |
| AD-1589484.1 | 42.00 | 4.07 |
| AD-1589489.1 | 48.76 | 4.70 |
| AD-1589492.1 | 49.56 | 0.95 |
| AD-1589495.1 | 41.49 | 1.52 |
| AD-1589500.1 | 45.27 | 2.63 |
| AD-1589502.1 | 40.72 | 5.27 |
| AD-1589503.1 | 34.66 | 4.26 |
| AD-1589505.1 | 49.92 | 5.07 |
| AD-1589510.1 | 60.71 | 3.52 |
| AD-1589513.1 | 50.63 | 3.53 |
| AD-1589518.1 | 50.71 | 1.51 |
| AD-1589520.1 | 66.84 | 2.14 |
| AD-1589521.1 | 52.98 | 3.13 |
| AD-1589523.1 | 46.04 | 1.48 |
| AD-1589528.1 | 55.38 | 1.74 |

TABLE 11-continued

| In vitro screen of human GRB14 siRNA in Hep3B cells | | |
|---|---|---|
| | 10 nM Dose | |
| Duplex | Avg % mRNA Remaining | SD |
| AD-1589531.1 | 42.85 | 1.59 |
| AD-1589625.1 | 43.94 | 0.92 |
| AD-1589628.1 | 49.84 | 1.20 |
| AD-1589633.1 | 34.44 | 0.65 |
| AD-1589636.1 | 51.83 | 2.39 |
| AD-1589665.1 | 50.61 | 0.56 |
| AD-1589668.1 | 51.08 | 5.33 |
| AD-1589673.1 | 40.78 | 0.91 |
| AD-1589676.1 | 52.15 | 2.58 |
| AD-1589685.1 | 39.88 | 2.23 |
| AD-1589688.1 | 46.89 | 2.45 |
| AD-1589693.1 | 39.34 | 1.57 |
| AD-1589695.1 | 39.76 | 3.55 |
| AD-1589696.1 | 42.92 | 1.08 |
| AD-1589698.1 | 42.85 | 4.03 |
| AD-1589703.1 | 46.58 | 2.21 |
| AD-1589705.1 | 53.53 | 4.19 |
| AD-1589706.1 | 50.22 | 2.13 |
| AD-1589708.1 | 40.02 | 1.63 |
| AD-1589713.1 | 44.46 | 1.08 |
| AD-1589716.1 | 50.31 | 0.97 |
| AD-1589842.1 | 41.11 | 1.14 |
| AD-1589845.1 | 28.07 | 0.72 |
| AD-1589850.1 | 35.63 | 0.08 |
| AD-1589853.1 | 43.51 | 0.93 |
| AD-1589902.1 | 43.06 | 0.65 |
| AD-1589905.1 | 98.24 | 3.92 |
| AD-1589910.1 | 50.46 | 1.67 |
| AD-1589913.1 | 37.11 | 0.56 |
| AD-1589923.1 | 41.57 | 1.08 |
| AD-1589925.1 | 38.95 | 0.87 |
| AD-1589926.1 | 43.59 | 1.59 |
| AD-1589928.1 | 36.65 | 2.54 |
| AD-1589933.1 | 49.39 | 3.85 |
| AD-1590015.1 | 41.65 | 0.92 |
| AD-1590018.1 | 57.24 | 1.54 |
| AD-1590023.1 | 48.30 | 4.24 |
| AD-1590026.1 | 37.70 | 3.22 |
| AD-1590045.1 | 58.10 | 0.15 |
| AD-1590048.1 | 52.79 | 3.07 |
| AD-1590053.1 | 40.12 | 2.84 |
| AD-1590056.1 | 45.89 | 6.21 |
| AD-1590085.1 | 53.79 | 2.10 |
| AD-1590088.1 | 61.52 | 4.99 |
| AD-1590093.1 | 41.68 | 3.96 |
| AD-1590096.1 | 54.34 | 5.50 |
| AD-1590145.1 | 58.82 | 5.86 |
| AD-1590148.1 | 55.25 | 1.97 |
| AD-1590153.1 | 53.06 | 3.54 |
| AD-1590155.1 | 52.27 | 6.79 |
| AD-1590156.1 | 51.71 | 2.93 |
| AD-1590158.1 | 51.50 | 3.37 |
| AD-1590163.1 | 60.72 | 6.15 |
| AD-1590166.1 | 62.36 | 1.15 |
| AD-1590192.1 | 49.60 | 1.77 |
| AD-1590195.1 | 45.82 | 1.80 |
| AD-1590200.1 | 23.58 | 0.82 |
| AD-1590203.1 | 34.66 | 0.46 |
| AD-1631258.1 | 95.41 | 9.65 |
| AD-1631259.1 | 48.20 | 3.73 |
| AD-1631260.1 | 47.29 | 2.17 |
| AD-1631261.1 | 59.18 | 3.36 |
| AD-1631262.1 | 51.89 | 2.58 |
| AD-1631263.1 | 45.21 | 1.57 |
| AD-1631264.1 | 68.99 | 1.67 |
| AD-1631265.1 | 55.77 | 7.06 |
| AD-1631266.1 | 56.89 | 5.39 |
| AD-1631267.1 | 66.14 | 0.81 |
| AD-1631268.1 | 70.74 | 8.79 |
| AD-1631269.1 | 29.86 | 1.84 |
| AD-1631270.1 | 32.73 | 1.74 |
| AD-1631271.1 | 38.97 | 4.34 |

Example 3: Genome Wide Association of Diabetes-Related Traits with GIGYF1

A set of 15,610 genes harboring more than one rare (MAF<1%) predicted loss of function (LOF) variants were identified in 246,731 whole exome sequences from the unrelated white British population in UK Biobank. As the majority of the variants were too rare to test individually, SKAT-o and other gene-level tests were performed to examine the association of loss of function in these genes with diabetes-related traits and biomarkers controlling for age, sex and genetic ancestry via 12 principal components. The second most significant associations were seen for GIGYF1 (OR=4.5, $p=2.0\times10^{-10}$), a gene not previously implicated by human genetics, in diabetes. Loss of function in GIGYF1 strongly associated 10 with increased levels of glucose (0.83 mmol/L or 0.67 SD increase, $p=9.2\times10^{-10}$) and HbA1c (4.53 mmol/mol or 0.67 SD increase, $p=2.5\times10^{-11}$). Out of 88 heterozygous carriers of a LOF in GIGYF1, 22 had been diagnosed with diabetes (ICD10 E10-E14) (OR=4.5, $p=2.8\times10^{-9}$), each being diagnosed with type 2 diabetes (ICD10 E11) in particular (OR=4.81, $p=5.4\times10^{-1}$) whereas no association was shown with type 1 diabetes (p=0.11). Out of the 88 carriers, 45 had either a medical diagnosis, self-report, or family history of diabetes (OR=3.0, $p=2.5\times10^{-7}$,). The statistical significance of GIGYF1 associations with glucose and HbA1c were slightly reduced after adjusting for type 2 diabetes medication use (0.59 mmol/L increase, $p=6.1\times10^{-6}$; 2.93 mmol/mol increase, $p=3.8\times10^{-6}$, respectively), but less so when individuals on medication were excluded (0.75 mmol/L increase, $p=1.2\times10^{-7}$; 3.47 mmol/mol increase, $p=5.7\times10^{-7}$, respectively). GIGYF1 loss of function carriers may be less likely to respond to insulin medication due to an inherent defect in insulin signaling regulation, which could explain why carriers on medication still have higher glucose and HbA1c levels than non-carriers. Carriers had a higher BMI than non-carriers (p=0.005), but the association of GIGYF1 loss of function with type 2 diabetes remained significant when adjusted for BMI (OR=4.23, $p=1.24\times10^{-7}$). GIGYF loss of function also associated with decreased levels of IGF-1 (0.44 SD decrease, $p=2.7\times10^{-5}$), indicative of a dual role in insulin and IGF-1 signaling; decreased cholesterol, including LDL cholesterol (0.65 SD decrease; $p=2.4\times10^{-9}$) decreased grip strength; decreased peak expiratory flow; increased waist circumference; and increased leg fat mass. These results suggest that GIGYF1 and GRB10 have strong roles in regulating insulin signaling and in protecting from diabetes. The most common GIGYF1 loss of function variant in the study was rs770150936 (hg38 7:100687545:CA:C, MAF=0.0049%), carried by 24 individuals and removal of which lowered statistical significance for glucose and HbA1c ($p=3.8\times10^{-8}$, $p=1.2\times10^{-6}$, respectively). Conditional analysis showed that GIGYF1 loss of function associations with glucose and HbA1c were independent of associations with rs221783, which is best expression quantitative trait locus (eQTL) for GIGYF1 in several tissues including pancreas, adipose and thyroid.

It will be understood that, as used herein, any reference to "GRB10/14" or "GRB14/10" refers to either GRB10 or GRB14 (not excluding the possibility of both). It will be further understood that when a single sentence refers to GRB10 or GRB14 being associated with any tables or sequences, that tables and sequences which are explicitly associated with either GRB10 or GRB14 elsewhere in the disclosure should be understood to be associated with the same gene or protein in that sentence.

GRB10/GRB14 SEQUENCES
>NM_001350814.2 *Homo sapiens* growth factor receptor bound protein 10 (GRB10), transcript variant 1, mRNA

SEQ ID NO: 1

GGGATTCCTGTTGTGCTCCAGGACCGGGCGCTGCTCCGTCGTCCTCCCGCTCCTCAGGAGCGCCCAGTCCCTCGG

AGGCTGAGTATTGCAGCCGGGCGGCAGCCGGCTCCGCGGAGGGGCCCCCGGGCACCTGCGTGGTGATGGCGCTGG

GAGCCCCCGGGCACGCTCGGGCGGTGGCGCGGCATCCCACCCTCGCCCGGATGGCGTCCCCAGAGGCGGCGTTGG

CCCGCTTTTCGTGCTAGCGCGTTCGCCTGGCGCGCGGTGGCCCCGAGGCCCCGGGTCGGTTTTCTGCGCCGCAGG

CCCCTGGCCGGGGCGGAGCCGTGGAGGACCAGCCCGGCCCGGCTCCGAGCGCTGTCCATGCGGAGCGCTGTCCAC

GCGCCGGGCACTGCGGGGGCCGGGCCCCGAAGCCCTACCCGGGCCGGCGGCGCACACGCAGCGACCCCGTGCGGC

CAGTGCTGCCGCCCGCTCTCCAGACTTGGGAGGCTGCATTCTGATAATTCTCAGGAGGAAGAATGTATAGGAGAG

ACCAGGGTTTTTAAGGTGTGACCTCTGAACCACCTACATCAGAGCTGACTGCCTCTCGCTTTGGCGCTGACCACA

ATGCTGAGCAGGAAGCAGCAGCTGCAGGCCCAGTGACTGGTAGCTCAGTGACCAGCAGCCCAGTGACCGGCAGCC

AGGTCCTCACCTGGGTCCTCTCAGTGAAGCCAGGGTGGCCGCCCCAGCAGACAGTGCTACAGAGCCAACTCCTGA

CAGGTGCTGCAGCGCAGTAAATGTAATTTGAAGAAGGCAGAAGGAACCCATGGCTTTAGCCGGCTGCCCAGATTC

CTTTTTGCACCATCCGTACTACCAGGACAAGGTGGAGCAGACACCTCGCAGTCAACAAGACCCGGCAGGACCAGG

ACTCCCCGCACAGTCTGACCGACTTGCGAATCACCAGGAGGATGATGTGGACCTGGAAGCCCTGGTGAACGATAT

GAATGCATCCCTGGAGAGCCTGTACTCGGCCTGCAGCATGCAGTCAGACACGGTGCCCCTCCTGCAGAATGGCCA

GCATGCCCGCAGCCAGCCTCGGGCTTCAGGCCCTCCTCGGTCCATCCAGCCACAGGTGTCCCCGAGGCAGAGGGT

GCAGCGCTCCCAGCCTGTGCACATCCTCGCTGTCAGGCGCCTTCAGGAGGAAGACCAGCAGTTTAGAACCTCATC

TCTGCCGGCCATCCCCAATCCTTTTCCTGAACTCTGTGGCCCTGGGAGCCCCCCTGTGCTCACGCCGGGTTCTTT

ACCTCCGAGCCAGGCCGCCGCAAAGCAGGATGTTAAAGTCTTTAGTGAAGATGGGACAAGCAAAGTGGTGGAGAT

TCTAGCAGACATGACAGCCAGAGACCTGTGCCAATTGCTGGTTTACAAAAGTCACTGTGTGGATGACAACAGCTG

GACACTAGTGGAGCACCACCCGCACCTAGGATTAGAGAGGTGCTTGGAAGACCATGAGCTGGTGGTCCAGGTGGA

GAGTACCATGGCCAGTGAGAGTAAATTTCTATTCAGGAAGAATTACGCAAAATACGAGTTCTTTAAAAATCCCAT

GAATTTCTTCCCAGAACAGATGGTTACTTGGTGCCAGCAGTCAAATGGCAGTCAAACCCAGCTTTTGCAGAATTT

TCTGAACTCCAGTAGTTGTCCTGAAATTCAAGGGTTTTTGCATGTGAAAGAGCTGGGAAAGAAATCATGGAAAAA

GCTGTATGTGTGTTTGCGGAGATCTGGCCTTTATTGCTCCACCAAGGGAACTTCAAAGGAACCCAGACACCTGCA

GCTGCTGGCCGACCTGGAGGACAGCAACATCTTCTCCCTGATCGCTGGCAGGAAGCAGTACAACGCCCCTACAGA

CCACGGGCTCTGCATAAAGCCAAACAAAGTCAGGAATGAAACTAAAGAGCTGAGGTTGCTCTGTGCAGAGGACGA

GCAAACCAGGACGTGCTGGATGACAGCGTTCAGACTCCTCAAGTATGGAATGCTCCTTTACCAGAATTACCGAAT

CCCTCAGCAGAGGAAGGCCTTGCTGTCCCCGTTCTCGACGCCAGTGCGCAGTGTCTCCGAGAACTCCCTCGTGGC

AATGGATTTTTCTGGGCAAACAGGACGCGTGATAGAGAATCCGGCAGAGGCCCAGAGCGCAGCCCTGGAGGAGGG

CCACGCCTGGAGGAAGCGAAGCACACGGATGAACATCCTAGGTAGCCAAAGTCCCCTCCACCCTTCTACCCTAAG

TACAGTGATTCACAGGACACAGCACTGGTTTCACGGGAGGATCTCCAGGGAGGAATCCCACAGGATCATTAAACA

GCAAGGGCTCGTGGATGGGCTTTTTCTCCTCCGTGACAGCCAGAGTAATCCAAAGGCATTTGTACTCACACTGTG

TCATCACCAGAAAATTAAAAATTTCCAGATCTTACCTTGCGAGGACGACGGGCAGACGTTCTTCAGCCTAGATGA

CGGGAACACCAAATTCTCTGACCTGATCCAGCTGGTTGACTTTTACCAGCTGAACAAAGGAGTCCTGCCTTGCAA

ACTCAAGCACCACTGCATCCGAGTGGCCTTATGACCGCAGATGTCCTCTCGGCTGAAGACTGGAGGAAGTGAACA

CTGGAGTGAAGAAGCGGTCTGTGCGTTGGTGAAGAACACACATCGATTCTGCACCTGGGGACCCAGAGCGAGATG

GGTTTGTTCGGTGCCAGCCGACCAAGATTGACTAGTTTGTTGGACTTAAACGACGATTTGCTGCTGTGAACCCAG

CAGGGTCGCCTCCCTCTGCATCGGCCAAATTGGGGAGGGCATGGAAGATCCAGCGGAAAGTTGAAAATAAACTGG

AATGATCATCTTGGCTTGGGCCGCTTAGGAACAAGAACCGGAGAGAAGTGATTGGAAATGAACTCTTGCCCTGGA

-continued

ATAATCTTGACAATTAAAACTGATATGTTTACTTTTTTTGTATTGATCACTTTTTTGCACTCCTTCTTTGTTTTC

AATATTGTATTCAGCCTATTGTAGGAGGGGGATGTGGCGTTTCAACTCATATAATACAGAAAGAGTTTTGAATGG

GCAGATTTCAAACTGAATATGGGTCCCCAAATGTTCCCAGAGGGTCCTCCACACCCTCTGCCGACTACCACGGTG

TGGATTCAGCTCCCAAATGACAAACCCAGCCCTTCCCAGTATACTTGAAAAGCTTTCTTGTTAAAATAAAAGGTG

TCACTGTGGTAGGCATTTGGCATATTTTGTGGACTCAGTCAAGCAACCACAGTCTGTTAATCATTTCTCTATGCT

CAGATGTCAGATCCTCTTGTTATTAGTGTGTCTTGTTCTGCACAGTGCAGGAGACTTTATTCCTTTGGAAAATTC

ACTGTTCCACAAACAGCAGGCTGAATGGCCTCGCCTCTAGATTGACGTGGGCCAGCCTCCTTGAGACACACCTGG

CACCCGTCATCGGCCAGCGGTGGATGCTGCATAATCCACCTGGGTACTTCAGCCTTGCGTTTCCACAGCCTTCAG

CCTGTTCTAGAACGATCACTGCCTTACCCCTGCTGCTGCAGTGGTGTGAGTCGTTTCACGGCTGATGTCCCTCGG

GGGATTAAAGGATCTAAAGAGAAAATGGCACCTGGTTGTCTTCGTGCTGTGTCTCATGGGTTTCCATAGTGATAA

AGACAAGGAAACGCTGCAGGGGCCACAGGCACAGGCTGATATTTAAAGATCTTTGCTTGCAGCCCTCCGTCCTGC

TGAAAACCCCCATAAGCCAGTGAACACAGAGCAGCTAGAGGCTCCTCCTCTGCTGGCTTAGGGTCAGAAGTACCT

CACAGTGGTTGTGGACATGGAAGAGTTTTGTCAACACAACACTTTGTCCCCGCTCCGGGAGATGAGTCAGATGGT

GGCTTGAGTTGTCACTTGGTCCCCTCCGCCCCTCGGGTGGCCCCCTTTGCCACGTCCCCTTAGCTTAGTGATCAG

GTGTGAGAGTGGCCATTTCCTTACCTTTGATCCCTGTAAAGCAGAAAGGACTCCTTTGACAGGCGACAAACTACT

GTGGTGAGCAGAATGATTTCCTTTTTCAAGACAACACCTGCCTGGCTTCTATTAATGTGTGCTGGCCATGATATT

GCCCCAAATCCGCCCCACTGAAGTGTTCCCTAAGGAACAGCATTTCTCTGCTCCTCAGTCAACCCCCGTAGCCTA

GAGCAGTGTCACAAGCTTCAGTAAGGCCAGTCAGCTGGAAGTCAGTCTACCGTATAGTAACACTGTATGTCAGTC

TACAGACCACACTCTAGTTGTTTTCCATGAAAGGTATACAAATGAAGAATTTTCTAGCAAAACATGTTTTTAACC

ATCAGTGCTCAATTGCATTTTCTTCCTTTCGCAGCCAGTCAGTCTTTCAAACTATTGACAGTAAGATAATTCTCA

CGTTCACACCTGGTGGCAGGCTTCACTGTAGGGACGGACATTGCAGTTACACCACGATTCCTTCCTCTTCACTGG

CTCGAGGTAAACCCTTTTCAAGGAAAAACAACTCTAGGATTTCTTTTTTCTGTGTACGTAGACCAGTCCCATCAG

TGTATAATCTCTCTCTCACACGCCTCTCTCCAATAGACAGCTTGTATTTGCAGTATTTCATATTTATAAATATGC

GTTTATTTAAAAGGAGAACAAAAGCTTGACTCTGATTCACAGTTTTGTATGTAGCTGGTTTGACGTAGTCTTTTG

TATTTTCCCTGCCGAAGTGAATTGTTGGAGAATGTAAACCGCCTCCACGTGGCGGCAGACTTCCTAAGGCCCCAG

CTCGCTGGCCTCGCGCTGGGCGGCTGGGAATTCCACCTGAGAACAAGTCCCGCAAACCGGGGACGGAAGGACATT

TGACTTTTATTTTTGTATTTAATTGACATGAATGTAAAGGGGACAGCTCAGGGTTGTTTTGGAGCCTGTTGACTT

TGTATCTCTGCCTGTGATTTTCTTTTCTAAATGAAACTCCATGTAGCAACCAGGACGAAGTTGAGAAGGAAAACG

CCAAATGCTTTGGTTATTAGAGTTTAATAGGTAAGCTCTGTTACACTAGGTGTTAGAGTTCCAGAATGTTCTTTT

GTTTGCTAAACCTTGAAGAAACATGTGCCTCAGCCTAGATGTTTTGTCTTCTCTTTTCTGCACTTAATACCTGAC

AGTATGACCGATCTCTGCGCCTTTCTGGGGGCGGGCAAGCTGGCGGTAGATTTGTGATGTCACAGTGCAAACTGC

AGTGACTGTAAATTGGCCTGGCGTGTATAAACGTTTTCAGGGAATGCAGAAGGTATTAATGAAGAGACAAAACCT

TTATTCCATGTGCTTTGCTTCATTCTGTACATAGCTCTTTGGCTCGTGAACCTAATTGTAAACTTTCAGGTATTT

TTGTACAAATAAGGGACTGATGTTCTGTTTCTTGTAATTAGAAATAAACATTAATACAGTGTTCTTCA

>Reverse Complement of SEQ ID NO: 1

SEQ ID NO: 2

TGAAGAACACTGTATTAATGTTTATTTCTAATTACAAGAAACAGAACATCAGTCCCTTATTTGTACAAAAATACC

TGAAAGTTTACAATTAGGTTCACGAGCCAAAGAGCTATGTACAGAATGAAGCAAAGCACATGGAATAAAGGTTTT

GTCTCTTCATTAATACCTTCTGCATTCCCTGAAAACGTTTATACACGCCAGGCCAATTTACAGTCACTGCAGTTT

GCACTGTGACATCACAAATCTACCGCCAGCTTGCCCGCCCCCAGAAAGGCGCAGAGATCGGTCATACTGTCAGGT

ATTAAGTGCAGAAAAGAGAAGACAAAACATCTAGGCTGAGGCACATGTTTCTTCAAGGTTTAGCAAACAAAAGAA

-continued

CATTCTGGAACTCTAACACCTAGTGTAACAGAGCTTACCTATTAAACTCTAATAACCAAAGCATTTGGCGTTTTC

CTTCTCAACTTCGTCCTGGTTGCTACATGGAGTTTCATTTAGAAAAGAAAATCACAGGCAGAGATACAAAGTCAA

CAGGCTCCAAAACAACCCTGAGCTGTCCCCTTTACATTCATGTCAATTAAATACAAAAATAAAAGTCAAATGTCC

TTCCGTCCCCGGTTTGCGGGACTTGTTCTCAGGTGGAATTCCCAGCCGCCCAGCGCGAGGCCAGCGAGCTGGGGC

CTTAGGAAGTCTGCCGCCACGTGGAGGCGGTTTACATTCTCCAACAATTCACTTCGGCAGGGAAAATACAAAAGA

CTACGTCAAACCAGCTACATACAAAACTGTGAATCAGAGTCAAGCTTTTGTTCTCCTTTTAAATAAACGCATATT

TATAAATATGAAATACTGCAAATACAAGCTGTCTATTGGAGAGAGGCGTGTGAGAGAGAGATTATACACTGATGG

GACTGGTCTACGTACACAGAAAAAAGAAATCCTAGAGTTGTTTTTCCTTGAAAAGGGTTTACCTCGAGCCAGTGA

AGAGGAAGGAATCGTGGTGTAACTGCAATGTCCGTCCCTACAGTGAAGCCTGCCACCAGGTGTGAACGTGAGAAT

TATCTTACTGTCAATAGTTTGAAAGACTGACTGGCTGCGAAAGGAAGAAAATGCAATTGAGCACTGATGGTTAAA

AACATGTTTTGCTAGAAAATTCTTCATTTGTATACCTTTCATGGAAAACAACTAGAGTGTGGTCTGTAGACTGAC

ATACAGTGTTACTATACGGTAGACTGACTTCCAGCTGACTGGCCTTACTGAAGCTTGTGACACTGCTCTAGGCTA

CGGGGGTTGACTGAGGAGCAGAGAAATGCTGTTCCTTAGGGAACACTTCAGTGGGGCGGATTTGGGGCAATATCA

TGGCCAGCACACATTAATAGAAGCCAGGCAGGTGTTGTCTTGAAAAAGGAAATCATTCTGCTCACCACAGTAGTT

TGTCGCCTGTCAAAGGAGTCCTTTCTGCTTTACAGGGATCAAAGGTAAGGAAATGGCCACTCTCACACCTGATCA

CTAAGCTAAGGGGACGTGGCAAAGGGGGCCACCCGAGGGGCGGAGGGGACCAAGTGACAACTCAAGCCACCATCT

GACTCATCTCCCGGAGCGGGGACAAAGTGTTGTGTTGACAAAACTCTTCCATGTCCACAACCACTGTGAGGTACT

TCTGACCCTAAGCCAGCAGAGGAGGAGCCTCTAGCTGCTCTGTGTTCACTGGCTTATGGGGGTTTTCAGCAGGAC

GGAGGGCTGCAAGCAAAGATCTTTAAATATCAGCCTGTGCCTGTGGCCCCTGCAGCGTTTCCTTGTCTTTATCAC

TATGGAAACCCATGAGACACAGCACGAAGACAACCAGGTGCCATTTTCTCTTTAGATCCTTTAATCCCCCGAGGG

ACATCAGCCGTGAAACGACTCACACCACTGCAGCAGCAGGGGTAAGGCAGTGATCGTTCTAGAACAGGCTGAAGG

CTGTGGAAACGCAAGGCTGAAGTACCCAGGTGGATTATGCAGCATCCACCGCTGGCCGATGACGGGTGCCAGGTG

TGTCTCAAGGAGGCTGGCCCACGTCAATCTAGAGGCGAGGCCATTCAGCCTGCTGTTTGTGGAACAGTGAATTTT

CCAAAGGAATAAAGTCTCCTGCACTGTGCAGAACAAGACACACTAATAACAAGAGGATCTGACATCTGAGCATAG

AGAAATGATTAACAGACTGTGGTTGCTTGACTGAGTCCACAAAATATGCCAAATGCCTACCACAGTGACACCTTT

TATTTTAACAAGAAAGCTTTTCAAGTATACTGGGAAGGGCTGGGTTTGTCATTTGGGAGCTGAATCCACACCGTG

GTAGTCGGCAGAGGGTGTGGAGGACCCTCTGGGAACATTTGGGGACCCATATTCAGTTTGAAATCTGCCCATTCA

AAACTCTTTCTGTATTATATGAGTTGAAACGCCACATCCCCCTCCTACAATAGGCTGAATACAATATTGAAAACA

AAGAAGGAGTGCAAAAAAGTGATCAATACAAAAAAAGTAAACATATCAGTTTTAATTGTCAAGATTATTCCAGGG

CAAGAGTTCATTTCCAATCACTTCTCTCCGGTTCTTGTTCCTAAGCGGCCCAAGCCAAGATGATCATTCCAGTTT

ATTTTCAACTTTCCGCTGGATCTTCCATGCCCTCCCCAATTTGGCCGATGCAGAGGGAGGCGACCCTGCTGGGTT

CACAGCAGCAAATCGTCGTTTAAGTCCAACAAACTAGTCAATCTTGGTCGGCTGGCACCGAACAAACCCATCTCG

CTCTGGGTCCCCAGGTGCAGAATCGATGTGTGTTCTTCACCAACGCACAGACCGCTTCTTCACTCCAGTGTTCAC

TTCCTCCAGTCTTCAGCCGAGAGGACATCTGCGGTCATAAGGCCACTCGGATGCAGTGGTGCTTGAGTTTGCAAG

GCAGGACTCCTTTGTTCAGCTGGTAAAAGTCAACCAGCTGGATCAGGTCAGAGAATTTGGTGTTCCCGTCATCTA

GGCTGAAGAACGTCTGCCCGTCGTCCTCGCAAGGTAAGATCTGGAAATTTTTAATTTTCTGGTGATGACACAGTG

TGAGTACAAATGCCTTTGGATTACTCTGGCTGTCACGGAGGAGAAAAAGCCCATCCACGAGCCCTTGCTGTTTAA

TGATCCTGTGGGATTCCTCCCTGGAGATCCTCCCGTGAAACCAGTGCTGTGTCCTGTGAATCACTGTACTTAGGG

TAGAAGGGTGGAGGGGACTTTGGCTACCTAGGATGTTCATCCGTGTGCTTCGCTTCCTCCAGGCGTGGCCCTCCT

CCAGGGCTGCGCTCTGGGCCTCTGCCGGATTCTCTATCACGCGTCCTGTTTGCCCAGAAAAATCCATTGCCACGA

GGGAGTTCTCGGAGACACTGCGCACTGGCGTCGAGAACGGGGACAGCAAGGCCTTCCTCTGCTGAGGGATTCGGT

-continued

AATTCTGGTAAAGGAGCATTCCATACTTGAGGAGTCTGAACGCTGTCATCCAGCACGTCCTGGTTTGCTCGTCCT

CTGCACAGAGCAACCTCAGCTCTTTAGTTTCATTCCTGACTTTGTTTGGCTTTATGCAGAGCCCGTGGTCTGTAG

GGGCGTTGTACTGCTTCCTGCCAGCGATCAGGGAGAAGATGTTGCTGTCCTCCAGGTCGGCCAGCAGCTGCAGGT

GTCTGGGTTCCTTTGAAGTTCCCTTGGTGGAGCAATAAAGGCCAGATCTCCGCAAACACACATACAGCTTTTTCC

ATGATTTCTTTCCCAGCTCTTTCACATGCAAAAACCCTTGAATTTCAGGACAACTACTGGAGTTCAGAAAATTCT

GCAAAAGCTGGGTTTGACTGCCATTTGACTGCTGGCACCAAGTAACCATCTGTTCTGGGAAGAAATTCATGGGAT

TTTTAAAGAACTCGTATTTTGCGTAATTCTTCCTGAATAGAAATTTACTCTCACTGGCCATGGTACTCTCCACCT

GGACCACCAGCTCATGGTCTTCCAAGCACCTCTCTAATCCTAGGTGCGGGTGGTGCTCCACTAGTGTCCAGCTGT

TGTCATCCACACAGTGACTTTTGTAAACCAGCAATTGGCACAGGTCTCTGGCTGTCATGTCTGCTAGAATCTCCA

CCACTTTGCTTGTCCCATCTTCACTAAAGACTTTAACATCCTGCTTTGCGGCGGCCTGGCTCGGAGGTAAAGAAC

CCGGCGTGAGCACAGGGGGGCTCCCAGGGCCACAGAGTTCAGGAAAAGGATTGGGGATGGCCGGCAGAGATGAGG

TTCTAAACTGCTGGTCTTCCTCCTGAAGGCGCCTGACAGCGAGGATGTGCACAGGCTGGGAGCGCTGCACCCTCT

GCCTCGGGGACACCTGTGGCTGGATGGACCGAGGAGGGCCTGAAGCCCGAGGCTGGCTGCGGGCATGCTGGCCAT

TCTGCAGGAGGGGCACCGTGTCTGACTGCATGCTGCAGGCCGAGTACAGGCTCTCCAGGGATGCATTCATATCGT

TCACCAGGGCTTCCAGGTCCACATCATCCTCCTGGTGATTCGCAAGTCGGTCAGACTGTGCGGGGAGTCCTGGTC

CTGCCGGGTCTTGTTGACTGCGAGGTGTCTGCTCCACCTTGTCCTGGTAGTACGGATGGTGCAAAAAGGAATCTG

GGCAGCCGGCTAAAGCCATGGGTTCCTTCTGCCTTCTTCAAATTACATTTACTGCGCTGCAGCACCTGTCAGGAG

TTGGCTCTGTAGCACTGTCTGCTGGGGCGGCCACCCTGGCTTCACTGAGAGGACCCAGGTGAGGACCTGGCTGCC

GGTCACTGGGCTGCTGGTCACTGAGCTACCAGTCACTGGGCCTGCAGCTGCTGCTTCCTGCTCAGCATTGTGGTC

AGCGCCAAAGCGAGAGGCAGTCAGCTCTGATGTAGGTGGTTCAGAGGTCACACCTTAAAAACCCTGGTCTCTCCT

ATACATTCTTCCTCCTGAGAATTATCAGAATGCAGCCTCCCAAGTCTGGAGAGCGGGCGGCAGCACTGGCCGCAC

GGGGTCGCTGCGTGTGCGCCGCCGGCCCGGGTAGGGCTTCGGGGCCCGGCCCCCGCAGTGCCCGGCGCGTGGACA

GCGCTCCGCATGGACAGCGCTCGGAGCCGGGCCGGGCTGGTCCTCCACGGCTCCGCCCCGGCCAGGGGCCTGCGG

CGCAGAAAACCGACCCGGGGCCTCGGGGCCACCGCGCGCCAGGCGAACGCGCTAGCACGAAAAGCGGGCCAACGC

CGCCTCTGGGGACGCCATCCGGGCGAGGGTGGGATGCCGCGCCACCGCCCGAGCGTGCCCGGGGGCTCCCAGCGC

CATCACCACGCAGGTGCCCGGGGGCCCCTCCGCGGAGCCGGCTGCCGCCCGGCTGCAATACTCAGCCTCCGAGGG

ACTGGGCGCTCCTGAGGAGCGGGAGGACGACGGAGCAGCGCCCGGTCCTGGAGCACAACAGGAATCCC

>NM_001001549.3 *Homo sapiens* growth factor receptor bound protein 10 (GRB10), transcript variant 2, mRNA

SEQ ID NO: 3

AAATGTAATTTGAAGAAGGCAGAAGGAACCCATGGCTTTAGCCGGCTGCCCAGATTCCTTTTTGCACCATCCGTA

CTACCAGGACAAGGTGGAGCAGACACCTCGCAGTCAACAAGACCCGGCAGGACCAGGACTCCCCGCACAGTCTGA

CCGACTTGCGAATCACCAGGAGGATGATGTGGACCTGGAAGCCCTGGTGAACGATATGAATGCATCCCTGGAGAG

CCTGTACTCGGCCTGCAGCATGCAGTCAGACACGGTGCCCCTCCTGCAGAATGGCCAGCATGCCCGCAGCCAGCC

TCGGGCTTCAGGCCCTCCTCGGTCCATCCAGCCACAGGTGTCCCCGAGGCAGAGGGTGCAGCGCTCCCAGCCTGT

GCACATCCTCGCTGTCAGGCGCCTTCAGGAGGAAGACCAGCAGTTTAGAACCTCATCTCTGCCGGCCATCCCCAA

TCCTTTTCCTGAACTCTGTGGCCCTGGGAGCCCCCCTGTGCTCACGCCGGGTTCTTTACCTCCGAGCCAGGCCGC

CGCAAAGCAGGATGTTAAAGTCTTTAGTGAAGATGGGACAAGCAAAGTGGTGGAGATTCTAGCAGACATGACAGC

CAGAGACCTGTGCCAATTGCTGGTTTACAAAAGTCACTGTGTGGATGACAACAGCTGGACACTAGTGGAGCACCA

CCCGCACCTAGGATTAGAGAGGTGCTTGGAAGACCATGAGCTGGTGGTCCAGGTGGAGAGTACCATGGCCAGTGA

GAGTAAATTTCTATTCAGGAAGAATTACGCAAAATACGAGTTCTTTAAAAATCCCATGAATTTCTTCCCAGAACA

GATGGTTACTTGGTGCCAGCAGTCAAATGGCAGTCAAACCCAGCTTTTGCAGGAACCCAGACACCTGCAGCTGCT

-continued

GGCCGACCTGGAGGACAGCAACATCTTCTCCCTGATCGCTGGCAGGAAGCAGTACAACGCCCCTACAGACCACGG

GCTCTGCATAAAGCCAAACAAAGTCAGGAATGAAACTAAAGAGCTGAGGTTGCTCTGTGCAGAGGACGAGCAAAC

CAGGACGTGCTGGATGACAGCGTTCAGACTCCTCAAGTATGGAATGCTCCTTTACCAGAATTACCGAATCCCTCA

GCAGAGGAAGGCCTTGCTGTCCCCGTTCTCGACGCCAGTGCGCAGTGTCTCCGAGAACTCCCTCGTGGCAATGGA

TTTTTCTGGGCAAACAGGACGCGTGATAGAGAATCCGGCAGAGGCCCAGAGCGCAGCCCTGGAGGAGGGCCACGC

CTGGAGGAAGCGAAGCACACGGATGAACATCCTAGGTAGCCAAAGTCCCCTCCACCCTTCTACCCTAAGTACAGT

GATTCACAGGACACAGCACTGGTTTCACGGGAGGATCTCCAGGGAGGAATCCCACAGGATCATTAAACAGCAAGG

GCTCGTGGATGGGCTTTTTCTCCTCCGTGACAGCCAGAGTAATCCAAAGGCATTTGTACTCACACTGTGTCATCA

CCAGAAAATTAAAAATTTCCAGATCTTACCTTGCGAGGACGACGGGCAGACGTTCTTCAGCCTAGATGACGGGAA

CACCAAATTCTCTGACCTGATCCAGCTGGTTGACTTTTACCAGCTGAACAAAGGAGTCCTGCCTTGCAAACTCAA

GCACCACTGCATCCGAGTGGCCTTATGACCGCAGATGTCCTCTCGGCTGAAGACTGGAGGAAGTGAACACTGGAG

TGAAGAAGCGGTCTGTGCGTTGGTGAAGAACACACATCGATTCTGCACCTGGGGACCCAGAGCGAGATGGGTTTG

TTCGGTGCCAGCCGACCAAGATTGACTAGTTTGTTGGACTTAAACGACGATTTGCTGCTGTGAACCCAGCAGGGT

CGCCTCCCTCTGCATCGGCCAAATTGGGGAGGGCATGGAAGATCCAGCGGAAAGTTGAAAATAAACTGGAATGAT

CATCTTGGCTTGGGCCGCTTAGGAACAAGAACCGGAGAGAAGTGATTGGAAATGAACTCTTGCCCTGGAATAATC

TTGACAATTAAAACTGATATGTTTACTTTTTTTGTATTGATCACTTTTTTGCACTCCTTCTTTGTTTTCAATATT

GTATTCAGCCTATTGTAGGAGGGGGATGTGGCGTTTCAACTCATATAATACAGAAAGAGTTTTGAATGGGCAGAT

TTCAAACTGAATATGGGTCCCCAAATGTTCCCAGAGGGTCCTCCACACCCTCTGCCGACTACCACGGTGTGGATT

CAGCTCCCAAATGACAAACCCAGCCCTTCCCAGTATACTTGAAAAGCTTTCTTGTTAAAATAAAAGGTGTCACTG

TGGTAGGCATTTGGCATATTTTGTGGACTCAGTCAAGCAACCACAGTCTGTTAATCATTTCTCTATGCTCAGATG

TCAGATCCTCTTGTTATTAGTGTGTCTTGTTCTGCACAGTGCAGGAGACTTTATTCCTTTGGAAAATTCACTGTT

CCACAAACAGCAGGCTGAATGGCCTCGCCTCTAGATTGACGTGGGCCAGCCTCCTTGAGACACACCTGGCACCCG

TCATCGGCCAGCGGTGGATGCTGCATAATCCACCTGGGTACTTCAGCCTTGCGTTTCCACAGCCTTCAGCCTGTT

CTAGAACGATCACTGCCTTACCCCTGCTGCTGCAGTGGTGTGAGTCGTTTCACGGCTGATGTCCCTCGGGGGATT

AAAGGATCTAAAGAGAAAATGGCACCTGGTTGTCTTCGTGCTGTGTCTCATGGGTTTCCATAGTGATAAAGACAA

GGAAACGCTGCAGGGGCCACAGGCACAGGCTGATATTTAAAGATCTTTGCTTGCAGCCCTCCGTCCTGCTGAAAA

CCCCCATAAGCCAGTGAACACAGAGCAGCTAGAGGCTCCTCCTCTGCTGGCTTAGGGTCAGAAGTACCTCACAGT

GGTTGTGGACATGGAAGAGTTTTGTCAACACAACACTTTGTCCCCGCTCCGGGAGATGAGTCAGATGGTGGCTTG

AGTIGTCACTTGGTCCCCTCCGCCCCTCGGGTGGCCCCCTTTGCCACGTCCCCTTAGCTTAGTGATCAGGTGTGA

GAGTGGCCATTTCCTTACCTTTGATCCCTGTAAAGCAGAAAGGACTCCTTTGACAGGCGACAAACTACTGTGGTG

AGCAGAATGATTTCCTTTTTCAAGACAACACCTGCCTGGCTTCTATTAATGTGTGCTGGCCATGATATTGCCCCA

AATCCGCCCCACTGAAGTGTTCCCTAAGGAACAGCATTTCTCTGCTCCTCAGTCAACCCCCGTAGCCTAGAGCAG

TGTCACAAGCTTCAGTAAGGCCAGTCAGCTGGAAGTCAGTCTACCGTATAGTAACACTGTATGTCAGTCTACAGA

CCACACTCTAGTTGTTTTCCATGAAAGGTATACAAATGAAGAATTTTCTAGCAAAACATGTTTTTAACCATCAGT

GCTCAATTGCATTTTCTTCCTTTCGCAGCCAGTCAGTCTTTCAAACTATTGACAGTAAGATAATTCTCACGTTCA

CACCTGGTGGCAGGCTTCACTGTAGGGACGGACATTGCAGTTACACCACGATTCCTTCCTCTTCACTGGCTCGAG

GTAAACCCTTTTCAAGGAAAAACAACTCTAGGATTTCTTTTTTCTGTGTACGTAGACCAGTCCCATCAGTGTATA

ATCTCTCTCTCACACGCCTCTCTCCAATAGACAGCTTGTATTTGCAGTATTTCATATTTATAAATATGCGTTTAT

TTAAAAGGAGAACAAAAGCTTGACTCTGATTCACAGTTTTGTATGTAGCTGGTTTGACGTAGTCTTTTGTATTTT

CCCTGCCGAAGTGAATTGTTGGAGAATGTAAACCGCCTCCACGTGGCGGCAGACTTCCTAAGGCCCCAGCTCGCT

-continued

GGCCTCGCGCTGGGCGGCTGGGAATTCCACCTGAGAACAAGTCCCGCAAACCGGGGACGGAAGGACATTTGACTT

TTATTTTTGTATTTAATTGACATGAATGTAAAGGGGACAGCTCAGGGTTGTTTTGGAGCCTGTTGACTTTGTATC

TCTGCCTGTGATTTTCTTTTCTAAATGAAACTCCATGTAGCAACCAGGACGAAGTTGAGAAGGAAAACGCCAAAT

GCTTTGGTTATTAGAGTTTAATAGGTAAGCTCTGTTACACTAGGTGTTAGAGTTCCAGAATGTTCTTTTGTTTGC

TAAACCTTGAAGAAACATGTGCCTCAGCCTAGATGTTTTGTCTTCTCTTTTCTGCACTTAATACCTGACAGTATG

ACCGATCTCTGCGCCTTTCTGGGGGCGGGCAAGCTGGCGGTAGATTTGTGATGTCACAGTGCAAACTGCAGTGAC

TGTAAATTGGCCTGGCGTGTATAAACGTTTTCAGGGAATGCAGAAGGTATTAATGAAGAGACAAAACCTTTATTC

CATGTGCTTTGCTTCATTCTGTACATAGCTCTTTGGCTCGTGAACCTAATTGTAAACTTTCAGGTATTTTTGTAC

AAATAAGGGACTGATGTTCTGTTTCTTGTAATTAGAAATAAACATTAATACAGTGTTCTTCA

>Reverse Complement of SEQ ID NO: 3

SEQ ID NO: 4

TGAAGAACACTGTATTAATGTTTATTTCTAATTACAAGAAACAGAACATCAGTCCCTTATTTGTACAAAAATACC

TGAAAGTTTACAATTAGGTTCACGAGCCAAAGAGCTATGTACAGAATGAAGCAAAGCACATGGAATAAAGGTTTT

GTCTCTTCATTAATACCTTCTGCATTCCCTGAAAACGTTTATACACGCCAGGCCAATTTACAGTCACTGCAGTTT

GCACTGTGACATCACAAATCTACCGCCAGCTTGCCCGCCCCCAGAAAGGCGCAGAGATCGGTCATACTGTCAGGT

ATTAAGTGCAGAAAAGAGAAGACAAAACATCTAGGCTGAGGCACATGTTTCTTCAAGGTTTAGCAAACAAAAGAA

CATTCTGGAACTCTAACACCTAGTGTAACAGAGCTTACCTATTAAACTCTAATAACCAAAGCATTTGGCGTTTTC

CTTCTCAACTTCGTCCTGGTTGCTACATGGAGTTTCATTTAGAAAAGAAAATCACAGGCAGAGATACAAAGTCAA

CAGGCTCCAAAACAACCCTGAGCTGTCCCCTTTACATTCATGTCAATTAAATACAAAAATAAAAGTCAAATGTCC

TTCCGTCCCCGGTTTGCGGGACTTGTTCTCAGGTGGAATTCCCAGCCGCCCAGCGCGAGGCCAGCGAGCTGGGGC

CTTAGGAAGTCTGCCGCCACGTGGAGGCGGTTTACATTCTCCAACAATTCACTTCGGCAGGGAAAATACAAAAGA

CTACGTCAAACCAGCTACATACAAAACTGTGAATCAGAGTCAAGCTTTTGTTCTCCTTTTAAATAAACGCATATT

TATAAATATGAAATACTGCAAATACAAGCTGTCTATTGGAGAGAGGCGTGTGAGAGAGAGATTATACACTGATGG

GACTGGTCTACGTACACAGAAAAAAGAAATCCTAGAGTTGTTTTTCCTTGAAAAGGGTTTACCTCGAGCCAGTGA

AGAGGAAGGAATCGTGGTGTAACTGCAATGTCCGTCCCTACAGTGAAGCCTGCCACCAGGTGTGAACGTGAGAAT

TATCTTACTGTCAATAGTTTGAAAGACTGACTGGCTGCGAAAGGAAGAAAATGCAATTGAGCACTGATGGTTAAA

AACATGTTTTGCTAGAAAATTCTTCATTTGTATACCTTTCATGGAAAACAACTAGAGTGTGGTCTGTAGACTGAC

ATACAGTGTTACTATACGGTAGACTGACTTCCAGCTGACTGGCCTTACTGAAGCTTGTGACACTGCTCTAGGCTA

CGGGGGTTGACTGAGGAGCAGAGAAATGCTGTTCCTTAGGGAACACTTCAGTGGGGCGGATTTGGGGCAATATCA

TGGCCAGCACACATTAATAGAAGCCAGGCAGGTGTTGTCTTGAAAAAGGAAATCATTCTGCTCACCACAGTAGTT

TGTCGCCTGTCAAAGGAGTCCTTTCTGCTTTACAGGGATCAAAGGTAAGGAAATGGCCACTCTCACACCTGATCA

CTAAGCTAAGGGGACGTGGCAAAGGGGGCCACCCGAGGGGCGGAGGGGACCAAGTGACAACTCAAGCCACCATCT

GACTCATCTCCCGGAGCGGGGACAAAGTGTTGTGTTGACAAAACTCTTCCATGTCCACAACCACTGTGAGGTACT

TCTGACCCTAAGCCAGCAGAGGAGGAGCCTCTAGCTGCTCTGTGTTCACTGGCTTATGGGGGTTTTCAGCAGGAC

GGAGGGCTGCAAGCAAAGATCTTTAAATATCAGCCTGTGCCTGTGGCCCCTGCAGCGTTTCCTTGTCTTTATCAC

TATGGAAACCCATGAGACACAGCACGAAGACAACCAGGTGCCATTTTCTCTTTAGATCCTTTAATCCCCCGAGGG

ACATCAGCCGTGAAACGACTCACACCACTGCAGCAGCAGGGGTAAGGCAGTGATCGTTCTAGAACAGGCTGAAGG

CTGTGGAAACGCAAGGCTGAAGTACCCAGGTGGATTATGCAGCATCCACCGCTGGCCGATGACGGGTGCCAGGTG

TGTCTCAAGGAGGCTGGCCCACGTCAATCTAGAGGCGAGGCCATTCAGCCTGCTGTTTGTGGAACAGTGAATTTT

CCAAAGGAATAAAGTCTCCTGCACTGTGCAGAACAAGACACACTAATAACAAGAGGATCTGACATCTGAGCATAG

AGAAATGATTAACAGACTGTGGTTGCTTGACTGAGTCCACAAAATATGCCAAATGCCTACCACAGTGACACCTTT

TATTTTAACAAGAAAGCTTTTCAAGTATACTGGGAAGGGCTGGGTTTGTCATTTGGGAGCTGAATCCACACCGTG

-continued

GTAGTCGGCAGAGGGTGTGGAGGACCCTCTGGGAACATTTGGGGACCCATATTCAGTTTGAAATCTGCCCATTCA

AAACTCTTTCTGTATTATATGAGTTGAAACGCCACATCCCCCTCCTACAATAGGCTGAATACAATATTGAAAACA

AAGAAGGAGTGCAAAAAAGTGATCAATACAAAAAAAGTAAACATATCAGTTTTAATTGTCAAGATTATTCCAGGG

CAAGAGTTCATTTCCAATCACTTCTCTCCGGTTCTTGTTCCTAAGCGGCCCAAGCCAAGATGATCATTCCAGTTT

ATTTTCAACTTTCCGCTGGATCTTCCATGCCCTCCCCAATTTGGCCGATGCAGAGGGAGGCGACCCTGCTGGGTT

CACAGCAGCAAATCGTCGTTTAAGTCCAACAAACTAGTCAATCTTGGTCGGCTGGCACCGAACAAACCCATCTCG

CTCTGGGTCCCCAGGTGCAGAATCGATGTGTGTTCTTCACCAACGCACAGACCGCTTCTTCACTCCAGTGTTCAC

TTCCTCCAGTCTTCAGCCGAGAGGACATCTGCGGTCATAAGGCCACTCGGATGCAGTGGTGCTTGAGTTTGCAAG

GCAGGACTCCTTTGTTCAGCTGGTAAAAGTCAACCAGCTGGATCAGGTCAGAGAATTTGGTGTTCCCGTCATCTA

GGCTGAAGAACGTCTGCCCGTCGTCCTCGCAAGGTAAGATCTGGAAATTTTTAATTTTCTGGTGATGACACAGTG

TGAGTACAAATGCCTTTGGATTACTCTGGCTGTCACGGAGGAGAAAAAGCCCATCCACGAGCCCTTGCTGTTTAA

TGATCCTGTGGGATTCCTCCCTGGAGATCCTCCCGTGAAACCAGTGCTGTGTCCTGTGAATCACTGTACTTAGGG

TAGAAGGGTGGAGGGGACTTTGGCTACCTAGGATGTTCATCCGTGTGCTTCGCTTCCTCCAGGCGTGGCCCTCCT

CCAGGGCTGCGCTCTGGGCCTCTGCCGGATTCTCTATCACGCGTCCTGTTTGCCCAGAAAAATCCATTGCCACGA

GGGAGTTCTCGGAGACACTGCGCACTGGCGTCGAGAACGGGGACAGCAAGGCCTTCCTCTGCTGAGGGATTCGGT

AATTCTGGTAAAGGAGCATTCCATACTTGAGGAGTCTGAACGCTGTCATCCAGCACGTCCTGGTTTGCTCGTCCT

CTGCACAGAGCAACCTCAGCTCTTTAGTTTCATTCCTGACTTTGTTTGGCTTTATGCAGAGCCCGTGGTCTGTAG

GGGCGTTGTACTGCTTCCTGCCAGCGATCAGGGAGAAGATGTTGCTGTCCTCCAGGTCGGCCAGCAGCTGCAGGT

GTCTGGGTTCCTGCAAAAGCTGGGTTTGACTGCCATTTGACTGCTGGCACCAAGTAACCATCTGTTCTGGGAAGA

AATTCATGGGATTTTTAAAGAACTCGTATTTTGCGTAATTCTTCCTGAATAGAAATTTACTCTCACTGGCCATGG

TACTCTCCACCTGGACCACCAGCTCATGGTCTTCCAAGCACCTCTCTAATCCTAGGTGCGGGTGGTGCTCCACTA

GTGTCCAGCTGTTGTCATCCACACAGTGACTTTTGTAAACCAGCAATTGGCACAGGTCTCTGGCTGTCATGTCTG

CTAGAATCTCCACCACTTTGCTTGTCCCATCTTCACTAAAGACTTTAACATCCTGCTTTGCGGCGGCCTGGCTCG

GAGGTAAAGAACCCGGCGTGAGCACAGGGGGGCTCCCAGGGCCACAGAGTTCAGGAAAAGGATTGGGGATGGCCG

GCAGAGATGAGGTTCTAAACTGCTGGTCTTCCTCCTGAAGGCGCCTGACAGCGAGGATGTGCACAGGCTGGGAGC

GCTGCACCCTCTGCCTCGGGGACACCTGTGGCTGGATGGACCGAGGAGGGCCTGAAGCCCGAGGCTGGCTGCGGG

CATGCTGGCCATTCTGCAGGAGGGGCACCGTGTCTGACTGCATGCTGCAGGCCGAGTACAGGCTCTCCAGGGATG

CATTCATATCGTTCACCAGGGCTTCCAGGTCCACATCATCCTCCTGGTGATTCGCAAGTCGGTCAGACTGTGCGG

GGAGTCCTGGTCCTGCCGGGTCTTGTTGACTGCGAGGTGTCTGCTCCACCTTGTCCTGGTAGTACGGATGGTGCA

AAAAGGAATCTGGGCAGCCGGCTAAAGCCATGGGTTCCTTCTGCCTTCTTCAAATTACATTT

>NM_001001550.3 *Homo sapiens* growth factor receptor bound protein 10
(GRB10), transcript variant 3, mRNA

SEQ ID NO: 5

CGCAACTTTGCCTCCCAGGGAACAAACATCCTCCTTCTAAGTGGTAGATGTGGGTGAGCTGACCCTGCTGGAGTC

TGTCCCCTGGGCTACCCTCTGCTTCCCCCCATTGTGAGTGGTCCGTGAAGCACAGCGTTGACCAGACCTAAACCT

GTTTGCTCCCAGGACAAGGTGGAGCAGACACCTCGCAGTCAACAAGACCCGGCAGGACCAGGACTCCCCGCACAG

TCTGACCGACTTGCGAATCACCAGGAGGATGATGTGGACCTGGAAGCCCTGGTGAACGATATGAATGCATCCCTG

GAGAGCCTGTACTCGGCCTGCAGCATGCAGTCAGACACGGTGCCCCTCCTGCAGAATGGCCAGCATGCCCGCAGC

CAGCCTCGGGCTTCAGGCCCTCCTCGGTCCATCCAGCCACAGGTGTCCCCGAGGCAGAGGGTGCAGCGCTCCCAG

CCTGTGCACATCCTCGCTGTCAGGCGCCTTCAGGAGGAAGACCAGCAGTTTAGAACCTCATCTCTGCCGGCCATC

CCCAATCCTTTTCCTGAACTCTGTGGCCCTGGGAGCCCCCCTGTGCTCACGCCGGGTTCTTTACCTCCGAGCCAG

GCCGCCGCAAAGCAGGATGTTAAAGTCTTTAGTGAAGATGGGACAAGCAAAGTGGTGGAGATTCTAGCAGACATG

-continued

ACAGCCAGAGACCTGTGCCAATTGCTGGTTTACAAAAGTCACTGTGTGGATGACAACAGCTGGACACTAGTGGAG

CACCACCCGCACCTAGGATTAGAGAGGTGCTTGGAAGACCATGAGCTGGTGGTCCAGGTGGAGAGTACCATGGCC

AGTGAGAGTAAATTTCTATTCAGGAAGAATTACGCAAAATACGAGTTCTTTAAAAATCCCATGAATTTCTTCCCA

GAACAGATGGTTACTTGGTGCCAGCAGTCAAATGGCAGTCAAACCCAGCTTTTGCAGAATTTTCTGAACTCCAGT

AGTIGTCCTGAAATTCAAGGGTTTTTGCATGTGAAAGAGCTGGGAAAGAAATCATGGAAAAAGCTGTATGTGTGT

TTGCGGAGATCTGGCCTTTATTGCTCCACCAAGGGAACTTCAAAGGAACCCAGACACCTGCAGCTGCTGGCCGAC

CTGGAGGACAGCAACATCTTCTCCCTGATCGCTGGCAGGAAGCAGTACAACGCCCCTACAGACCACGGGCTCTGC

ATAAAGCCAAACAAAGTCAGGAATGAAACTAAAGAGCTGAGGTTGCTCTGTGCAGAGGACGAGCAAACCAGGACG

TGCTGGATGACAGCGTTCAGACTCCTCAAGTATGGAATGCTCCTTTACCAGAATTACCGAATCCCTCAGCAGAGG

AAGGCCTTGCTGTCCCCGTTCTCGACGCCAGTGCGCAGTGTCTCCGAGAACTCCCTCGTGGCAATGGATTTTTCT

GGGCAAACAGGACGCGTGATAGAGAATCCGGCAGAGGCCCAGAGCGCAGCCCTGGAGGAGGGCCACGCCTGGAGG

AAGCGAAGCACACGGATGAACATCCTAGGTAGCCAAAGTCCCCTCCACCCTTCTACCCTAAGTACAGTGATTCAC

AGGACACAGCACTGGTTTCACGGGAGGATCTCCAGGGAGGAATCCCACAGGATCATTAAACAGCAAGGGCTCGTG

GATGGGCTTTTTCTCCTCCGTGACAGCCAGAGTAATCCAAAGGCATTTGTACTCACACTGTGTCATCACCAGAAA

ATTAAAAATTTCCAGATCTTACCTTGCGAGGACGACGGGCAGACGTTCTTCAGCCTAGATGACGGGAACACCAAA

TTCTCTGACCTGATCCAGCTGGTTGACTTTTACCAGCTGAACAAAGGAGTCCTGCCTTGCAAACTCAAGCACCAC

TGCATCCGAGTGGCCTTATGACCGCAGATGTCCTCTCGGCTGAAGACTGGAGGAAGTGAACACTGGAGTGAAGAA

GCGGTCTGTGCGTTGGTGAAGAACACACATCGATTCTGCACCTGGGGACCCAGAGCGAGATGGGTTTGTTCGGTG

CCAGCCGACCAAGATTGACTAGTTTGTTGGACTTAAACGACGATTTGCTGCTGTGAACCCAGCAGGGTCGCCTCC

CTCTGCATCGGCCAAATTGGGGAGGGCATGGAAGATCCAGCGGAAAGTTGAAAATAAACTGGAATGATCATCTTG

GCTTGGGCCGCTTAGGAACAAGAACCGGAGAGAAGTGATTGGAAATGAACTCTTGCCCTGGAATAATCTTGACAA

TTAAAACTGATATGTTTACTTTTTTTGTATTGATCACTTTTTTGCACTCCTTCTTTGTTTTCAATATTGTATTCA

GCCTATTGTAGGAGGGGGATGTGGCGTTTCAACTCATATAATACAGAAAGAGTTTTGAATGGGCAGATTTCAAAC

TGAATATGGGTCCCCAAATGTTCCCAGAGGGTCCTCCACACCCTCTGCCGACTACCACGGTGTGGATTCAGCTCC

CAAATGACAAACCCAGCCCTTCCCAGTATACTTGAAAAGCTTTCTTGTTAAAATAAAAGGTGTCACTGTGGTAGG

CATTTGGCATATTTTGTGGACTCAGTCAAGCAACCACAGTCTGTTAATCATTTCTCTATGCTCAGATGTCAGATC

CTCTTGTTATTAGTGTGTCTTGTTCTGCACAGTGCAGGAGACTTTATTCCTTTGGAAAATTCACTGTTCCACAAA

CAGCAGGCTGAATGGCCTCGCCTCTAGATTGACGTGGGCCAGCCTCCTTGAGACACACCTGGCACCCGTCATCGG

CCAGCGGTGGATGCTGCATAATCCACCTGGGTACTTCAGCCTTGCGTTTCCACAGCCTTCAGCCTGTTCTAGAAC

GATCACTGCCTTACCCCTGCTGCTGCAGTGGTGTGAGTCGTTTCACGGCTGATGTCCCTCGGGGGATTAAAGGAT

CTAAAGAGAAAATGGCACCTGGTTGTCTTCGTGCTGTGTCTCATGGGTTTCCATAGTGATAAAGACAAGGAAACG

CTGCAGGGGCCACAGGCACAGGCTGATATTTAAAGATCTTTGCTTGCAGCCCTCCGTCCTGCTGAAAACCCCCAT

AAGCCAGTGAACACAGAGCAGCTAGAGGCTCCTCCTCTGCTGGCTTAGGGTCAGAAGTACCTCACAGTGGTTGTG

GACATGGAAGAGTTTTGTCAACACAACACTTTGTCCCCGCTCCGGGAGATGAGTCAGATGGTGGCTTGAGTTGTC

ACTTGGTCCCCTCCGCCCCTCGGGTGGCCCCCTTTGCCACGTCCCCTTAGCTTAGTGATCAGGTGTGAGAGTGGC

CATTTCCTTACCTTTGATCCCTGTAAAGCAGAAAGGACTCCTTTGACAGGCGACAAACTACTGTGGTGAGCAGAA

TGATTTCCTTTTTCAAGACAACACCTGCCTGGCTTCTATTAATGTGTGCTGGCCATGATATTGCCCCAAATCCGC

CCCACTGAAGTGTTCCCTAAGGAACAGCATTTCTCTGCTCCTCAGTCAACCCCCGTAGCCTAGAGCAGTGTCACA

AGCTTCAGTAAGGCCAGTCAGCTGGAAGTCAGTCTACCGTATAGTAACACTGTATGTCAGTCTACAGACCACACT

CTAGTTGTTTTCCATGAAAGGTATACAAATGAAGAATTTTCTAGCAAAACATGTTTTTAACCATCAGTGCTCAAT

-continued

TGCATTTTCTTCCTTTCGCAGCCAGTCAGTCTTTCAAACTATTGACAGTAAGATAATTCTCACGTTCACACCTGG

TGGCAGGCTTCACTGTAGGGACGGACATTGCAGTTACACCACGATTCCTTCCTCTTCACTGGCTCGAGGTAAACC

CTTTTCAAGGAAAAACAACTCTAGGATTTCTTTTTTCTGTGTACGTAGACCAGTCCCATCAGTGTATAATCTCTC

TCTCACACGCCTCTCTCCAATAGACAGCTTGTATTTGCAGTATTTCATATTTATAAATATGCGTTTATTTAAAAG

GAGAACAAAAGCTTGACTCTGATTCACAGTTTTGTATGTAGCTGGTTTGACGTAGTCTTTTGTATTTTCCCTGCC

GAAGTGAATTGTTGGAGAATGTAAACCGCCTCCACGTGGCGGCAGACTTCCTAAGGCCCCAGCTCGCTGGCCTCG

CGCTGGGCGGCTGGGAATTCCACCTGAGAACAAGTCCCGCAAACCGGGGACGGAAGGACATTTGACTTTTATTTT

TGTATTTAATTGACATGAATGTAAAGGGGACAGCTCAGGGTTGTTTTGGAGCCTGTTGACTTTGTATCTCTGCCT

GTGATTTTCTTTTCTAAATGAAACTCCATGTAGCAACCAGGACGAAGTTGAGAAGGAAAACGCCAAATGCTTTGG

TTATTAGAGTTTAATAGGTAAGCTCTGTTACACTAGGTGTTAGAGTTCCAGAATGTTCTTTTGTTTGCTAAACCT

TGAAGAAACATGTGCCTCAGCCTAGATGTTTTGTCTTCTCTTTTCTGCACTTAATACCTGACAGTATGACCGATC

TCTGCGCCTTTCTGGGGGCGGGCAAGCTGGCGGTAGATTTGTGATGTCACAGTGCAAACTGCAGTGACTGTAAAT

TGGCCTGGCGTGTATAAACGTTTTCAGGGAATGCAGAAGGTATTAATGAAGAGACAAAACCTTTATTCCATGTGC

TTTGCTTCATTCTGTACATAGCTCTTTGGCTCGTGAACCTAATTGTAAACTTTCAGGTATTTTTGTACAAATAAG

GGACTGATGTTCTGTTTCTTGTAATTAGAAATAAACATTAATACAGTGTTCTTCA

>Reverse Complement of SEQ ID NO: 5

SEQ ID NO: 6

TGAAGAACACTGTATTAATGTTTATTTCTAATTACAAGAAACAGAACATCAGTCCCTTATTTGTACAAAAATACC

TGAAAGTTTACAATTAGGTTCACGAGCCAAAGAGCTATGTACAGAATGAAGCAAAGCACATGGAATAAAGGTTTT

GTCTCTTCATTAATACCTTCTGCATTCCCTGAAAACGTTTATACACGCCAGGCCAATTTACAGTCACTGCAGTTT

GCACTGTGACATCACAAATCTACCGCCAGCTTGCCCGCCCCCAGAAAGGCGCAGAGATCGGTCATACTGTCAGGT

ATTAAGTGCAGAAAAGAGAAGACAAAACATCTAGGCTGAGGCACATGTTTCTTCAAGGTTTAGCAAACAAAAGAA

CATTCTGGAACTCTAACACCTAGTGTAACAGAGCTTACCTATTAAACTCTAATAACCAAAGCATTTGGCGTTTTC

CTTCTCAACTTCGTCCTGGTTGCTACATGGAGTTTCATTTAGAAAAGAAAATCACAGGCAGAGATACAAAGTCAA

CAGGCTCCAAAACAACCCTGAGCTGTCCCCTTTACATTCATGTCAATTAAATACAAAAATAAAAGTCAAATGTCC

TTCCGTCCCCGGTTTGCGGGACTTGTTCTCAGGTGGAATTCCCAGCCGCCCAGCGCGAGGCCAGCGAGCTGGGGC

CTTAGGAAGTCTGCCGCCACGTGGAGGCGGTTTACATTCTCCAACAATTCACTTCGGCAGGGAAAATACAAAAGA

CTACGTCAAACCAGCTACATACAAAACTGTGAATCAGAGTCAAGCTTTTGTTCTCCTTTTAAATAAACGCATATT

TATAAATATGAAATACTGCAAATACAAGCTGTCTATTGGAGAGAGGCGTGTGAGAGAGAGATTATACACTGATGG

GACTGGTCTACGTACACAGAAAAAAGAAATCCTAGAGTTGTTTTTCCTTGAAAAGGGTTTACCTCGAGCCAGTGA

AGAGGAAGGAATCGTGGTGTAACTGCAATGTCCGTCCCTACAGTGAAGCCTGCCACCAGGTGTGAACGTGAGAAT

TATCTTACTGTCAATAGTTTGAAAGACTGACTGGCTGCGAAAGGAAGAAAATGCAATTGAGCACTGATGGTTAAA

AACATGTTTTGCTAGAAAATTCTTCATTTGTATACCTTTCATGGAAAACAACTAGAGTGTGGTCTGTAGACTGAC

ATACAGTGTTACTATACGGTAGACTGACTTCCAGCTGACTGGCCTTACTGAAGCTTGTGACACTGCTCTAGGCTA

CGGGGGTTGACTGAGGAGCAGAGAAATGCTGTTCCTTAGGGAACACTTCAGTGGGGCGGATTTGGGGCAATATCA

TGGCCAGCACACATTAATAGAAGCCAGGCAGGTGTTGTCTTGAAAAAGGAAATCATTCTGCTCACCACAGTAGTT

TGTCGCCTGTCAAAGGAGTCCTTTCTGCTTTACAGGGATCAAAGGTAAGGAAATGGCCACTCTCACACCTGATCA

CTAAGCTAAGGGGACGTGGCAAAGGGGGCCACCCGAGGGGCGGAGGGGACCAAGTGACAACTCAAGCCACCATCT

GACTCATCTCCCGGAGCGGGGACAAAGTGTTGTGTTGACAAAACTCTTCCATGTCCACAACCACTGTGAGGTACT

TCTGACCCTAAGCCAGCAGAGGAGGAGCCTCTAGCTGCTCTGTGTTCACTGGCTTATGGGGGTTTTCAGCAGGAC

GGAGGGCTGCAAGCAAAGATCTTTAAATATCAGCCTGTGCCTGTGGCCCCTGCAGCGTTTCCTTGTCTTTATCAC

TATGGAAACCCATGAGACACAGCACGAAGACAACCAGGTGCCATTTTCTCTTTAGATCCTTTAATCCCCCGAGGG

-continued

ACATCAGCCGTGAAACGACTCACACCACTGCAGCAGCAGGGGTAAGGCAGTGATCGTTCTAGAACAGGCTGAAGG

CTGTGGAAACGCAAGGCTGAAGTACCCAGGTGGATTATGCAGCATCCACCGCTGGCCGATGACGGGTGCCAGGTG

TGTCTCAAGGAGGCTGGCCCACGTCAATCTAGAGGCGAGGCCATTCAGCCTGCTGTTTGTGGAACAGTGAATTTT

CCAAAGGAATAAAGTCTCCTGCACTGTGCAGAACAAGACACACTAATAACAAGAGGATCTGACATCTGAGCATAG

AGAAATGATTAACAGACTGTGGTTGCTTGACTGAGTCCACAAAATATGCCAAATGCCTACCACAGTGACACCTTT

TATTTTAACAAGAAAGCTTTTCAAGTATACTGGGAAGGGCTGGGTTTGTCATTTGGGAGCTGAATCCACACCGTG

GTAGTCGGCAGAGGGTGTGGAGGACCCTCTGGGAACATTTGGGGACCCATATTCAGTTTGAAATCTGCCCATTCA

AAACTCTTTCTGTATTATATGAGTTGAAACGCCACATCCCCCTCCTACAATAGGCTGAATACAATATTGAAAACA

AAGAAGGAGTGCAAAAAAGTGATCAATACAAAAAAAGTAAACATATCAGTTTTAATTGTCAAGATTATTCCAGGG

CAAGAGTTCATTTCCAATCACTTCTCTCCGGTTCTTGTTCCTAAGCGGCCCAAGCCAAGATGATCATTCCAGTTT

ATTTTCAACTTTCCGCTGGATCTTCCATGCCCTCCCCAATTTGGCCGATGCAGAGGGAGGCGACCCTGCTGGGTT

CACAGCAGCAAATCGTCGTTTAAGTCCAACAAACTAGTCAATCTTGGTCGGCTGGCACCGAACAAACCCATCTCG

CTCTGGGTCCCCAGGTGCAGAATCGATGTGTGTTCTTCACCAACGCACAGACCGCTTCTTCACTCCAGTGTTCAC

TTCCTCCAGTCTTCAGCCGAGAGGACATCTGCGGTCATAAGGCCACTCGGATGCAGTGGTGCTTGAGTTTGCAAG

GCAGGACTCCTTTGTTCAGCTGGTAAAAGTCAACCAGCTGGATCAGGTCAGAGAATTTGGTGTTCCCGTCATCTA

GGCTGAAGAACGTCTGCCCGTCGTCCTCGCAAGGTAAGATCTGGAAATTTTTAATTTTCTGGTGATGACACAGTG

TGAGTACAAATGCCTTTGGATTACTCTGGCTGTCACGGAGGAGAAAAAGCCCATCCACGAGCCCTTGCTGTTTAA

TGATCCTGTGGGATTCCTCCCTGGAGATCCTCCCGTGAAACCAGTGCTGTGTCCTGTGAATCACTGTACTTAGGG

TAGAAGGGTGGAGGGGACTTTGGCTACCTAGGATGTTCATCCGTGTGCTTCGCTTCCTCCAGGCGTGGCCCTCCT

CCAGGGCTGCGCTCTGGGCCTCTGCCGGATTCTCTATCACGCGTCCTGTTTGCCCAGAAAAATCCATTGCCACGA

GGGAGTTCTCGGAGACACTGCGCACTGGCGTCGAGAACGGGGACAGCAAGGCCTTCCTCTGCTGAGGGATTCGGT

AATTCTGGTAAAGGAGCATTCCATACTTGAGGAGTCTGAACGCTGTCATCCAGCACGTCCTGGTTTGCTCGTCCT

CTGCACAGAGCAACCTCAGCTCTTTAGTTTCATTCCTGACTTTGTTTGGCTTTATGCAGAGCCCGTGGTCTGTAG

GGGCGTTGTACTGCTTCCTGCCAGCGATCAGGGAGAAGATGTTGCTGTCCTCCAGGTCGGCCAGCAGCTGCAGGT

GTCTGGGTTCCTTTGAAGTTCCCTTGGTGGAGCAATAAAGGCCAGATCTCCGCAAACACACATACAGCTTTTTCC

ATGATTTCTTTCCCAGCTCTTTCACATGCAAAAACCCTTGAATTTCAGGACAACTACTGGAGTTCAGAAAATTCT

GCAAAAGCTGGGTTTGACTGCCATTTGACTGCTGGCACCAAGTAACCATCTGTTCTGGGAAGAAATTCATGGGAT

TTTTAAAGAACTCGTATTTTGCGTAATTCTTCCTGAATAGAAATTTACTCTCACTGGCCATGGTACTCTCCACCT

GGACCACCAGCTCATGGTCTTCCAAGCACCTCTCTAATCCTAGGTGCGGGTGGTGCTCCACTAGTGTCCAGCTGT

TGTCATCCACACAGTGACTTTTGTAAACCAGCAATTGGCACAGGTCTCTGGCTGTCATGTCTGCTAGAATCTCCA

CCACTTTGCTTGTCCCATCTTCACTAAAGACTTTAACATCCTGCTTTGCGGCGGCCTGGCTCGGAGGTAAAGAAC

CCGGCGTGAGCACAGGGGGGCTCCCAGGGCCACAGAGTTCAGGAAAAGGATTGGGGATGGCCGGCAGAGATGAGG

TTCTAAACTGCTGGTCTTCCTCCTGAAGGCGCCTGACAGCGAGGATGTGCACAGGCTGGGAGCGCTGCACCCTCT

GCCTCGGGGACACCTGTGGCTGGATGGACCGAGGAGGGCCTGAAGCCCGAGGCTGGCTGCGGGCATGCTGGCCAT

TCTGCAGGAGGGGCACCGTGTCTGACTGCATGCTGCAGGCCGAGTACAGGCTCTCCAGGGATGCATTCATATCGT

TCACCAGGGCTTCCAGGTCCACATCATCCTCCTGGTGATTCGCAAGTCGGTCAGACTGTGCGGGGAGTCCTGGTC

CTGCCGGGTCTTGTTGACTGCGAGGTGTCTGCTCCACCTTGTCCTGGGAGCAAACAGGTTTAGGTCTGGTCAACG

-continued

CTGTGCTTCACGGACCACTCACAATGGGGGGAAGCAGAGGGTAGCCCAGGGGACAGACTCCAGCAGGGTCAGCTC

ACCCACATCTACCACTTAGAAGGAGGATGTTTGTTCCCTGGGAGGCAAAGTTGCG

>NM_001001555.3 *Homo sapiens* growth factor receptor bound protein 10 (GRB10), transcript variant 4, mRNA

SEQ ID NO: 7

GGGAGGAGGCAGAGAGGGAAGCGAGCTGCGGCCGGGCGGGCTCGGCGCTCGGAGACCCGGTGGAGCCCAAAGTTT

CCGCGCAGCCCCTGGGTGGCGGCAGCGCCGGCGGCGCGGGGCGCCCGGGACAGTCTTGAGCGCCGGCCTCGCCCC

GCGGGGACCCGCGCCCGCCGCCGGCCACGCCGAGTGTCGCCCGCAGCCACGCGGAGGCGGCGGGGAGCCGCGCGC

GGCAGCTTTGGCGCTGACCACAATGCTGAGCAGGAAGCAGCAGCTGCAGGCCCAGTGACTGGTAGCTCAGTGACC

AGCAGCCCAGTGACCGGCAGCCAGGTCCTCACCTGGGTCCTCTCAGTGAAGCCAGGGTGGCCGCCCCAGCAGACA

GTGCTACAGAGCCAACTCCTGACAGGACAAGGTGGAGCAGACACCTCGCAGTCAACAAGACCCGGCAGGACCAGG

ACTCCCCGCACAGTCTGACCGACTTGCGAATCACCAGGAGGATGATGTGGACCTGGAAGCCCTGGTGAACGATAT

GAATGCATCCCTGGAGAGCCTGTACTCGGCCTGCAGCATGCAGTCAGACACGGTGCCCCTCCTGCAGAATGGCCA

GCATGCCCGCAGCCAGCCTCGGGCTTCAGGCCCTCCTCGGTCCATCCAGCCACAGGTGTCCCCGAGGCAGAGGGT

GCAGCGCTCCCAGCCTGTGCACATCCTCGCTGTCAGGCGCCTTCAGGAGGAAGACCAGCAGTTTAGAACCTCATC

TCTGCCGGCCATCCCCAATCCTTTTCCTGAACTCTGTGGCCCTGGGAGCCCCCCTGTGCTCACGCCGGGTTCTTT

ACCTCCGAGCCAGGCCGCCGCAAAGCAGGATGTTAAAGTCTTTAGTGAAGATGGGACAAGCAAAGTGGTGGAGAT

TCTAGCAGACATGACAGCCAGAGACCTGTGCCAATTGCTGGTTTACAAAAGTCACTGTGTGGATGACAACAGCTG

GACACTAGTGGAGCACCACCCGCACCTAGGATTAGAGAGGTGCTTGGAAGACCATGAGCTGGTGGTCCAGGTGGA

GAGTACCATGGCCAGTGAGAGTAAATTTCTATTCAGGAAGAATTACGCAAAATACGAGTTCTTTAAAAATCCCAT

GAATTTCTTCCCAGAACAGATGGTTACTTGGTGCCAGCAGTCAAATGGCAGTCAAACCCAGCTTTTGCAGAATTT

TCTGAACTCCAGTAGTTGTCCTGAAATTCAAGGGTTTTTGCATGTGAAAGAGCTGGGAAAGAAATCATGGAAAAA

GCTGTATGTGTGTTTGCGGAGATCTGGCCTTTATTGCTCCACCAAGGGAACTTCAAAGGAACCCAGACACCTGCA

GCTGCTGGCCGACCTGGAGGACAGCAACATCTTCTCCCTGATCGCTGGCAGGAAGCAGTACAACGCCCCTACAGA

CCACGGGCTCTGCATAAAGCCAAACAAAGTCAGGAATGAAACTAAAGAGCTGAGGTTGCTCTGTGCAGAGGACGA

GCAAACCAGGACGTGCTGGATGACAGCGTTCAGACTCCTCAAGTATGGAATGCTCCTTTACCAGAATTACCGAAT

CCCTCAGCAGAGGAAGGCCTTGCTGTCCCCGTTCTCGACGCCAGTGCGCAGTGTCTCCGAGAACTCCCTCGTGGC

AATGGATTTTTCTGGGCAAACAGGACGCGTGATAGAGAATCCGGCAGAGGCCCAGAGCGCAGCCCTGGAGGAGGG

CCACGCCTGGAGGAAGCGAAGCACACGGATGAACATCCTAGGTAGCCAAAGTCCCCTCCACCCTTCTACCCTAAG

TACAGTGATTCACAGGACACAGCACTGGTTTCACGGGAGGATCTCCAGGGAGGAATCCCACAGGATCATTAAACA

GCAAGGGCTCGTGGATGGGCTTTTTCTCCTCCGTGACAGCCAGAGTAATCCAAAGGCATTTGTACTCACACTGTG

TCATCACCAGAAAATTAAAAATTTCCAGATCTTACCTTGCGAGGACGACGGGCAGACGTTCTTCAGCCTAGATGA

CGGGAACACCAAATTCTCTGACCTGATCCAGCTGGTTGACTTTTACCAGCTGAACAAAGGAGTCCTGCCTTGCAA

ACTCAAGCACCACTGCATCCGAGTGGCCTTATGACCGCAGATGTCCTCTCGGCTGAAGACTGGAGGAAGTGAACA

CTGGAGTGAAGAAGCGGTCTGTGCGTTGGTGAAGAACACACATCGATTCTGCACCTGGGGACCCAGAGCGAGATG

GGTTTGTTCGGTGCCAGCCGACCAAGATTGACTAGTTTGTTGGACTTAAACGACGATTTGCTGCTGTGAACCCAG

CAGGGTCGCCTCCCTCTGCATCGGCCAAATTGGGGAGGGCATGGAAGATCCAGCGGAAAGTTGAAAATAAACTGG

AATGATCATCTTGGCTTGGGCCGCTTAGGAACAAGAACCGGAGAGAAGTGATTGGAAATGAACTCTTGCCCTGGA

ATAATCTTGACAATTAAAACTGATATGTTTACTTTTTTTGTATTGATCACTTTTTTGCACTCCTTCTTTGTTTTC

AATATTGTATTCAGCCTATTGTAGGAGGGGGATGTGGCGTTTCAACTCATATAATACAGAAAGAGTTTTGAATGG

GCAGATTTCAAACTGAATATGGGTCCCCAAATGTTCCCAGAGGGTCCTCCACACCCTCTGCCGACTACCACGGTG

TGGATTCAGCTCCCAAATGACAAACCCAGCCCTTCCCAGTATACTTGAAAAGCTTTCTTGTTAAAATAAAAGGTG

-continued

TCACTGTGGTAGGCATTTGGCATATTTTGTGGACTCAGTCAAGCAACCACAGTCTGTTAATCATTTCTCTATGCT

CAGATGTCAGATCCTCTTGTTATTAGTGTGTCTTGTTCTGCACAGTGCAGGAGACTTTATTCCTTTGGAAAATTC

ACTGTTCCACAAACAGCAGGCTGAATGGCCTCGCCTCTAGATTGACGTGGGCCAGCCTCCTTGAGACACACCTGG

CACCCGTCATCGGCCAGCGGTGGATGCTGCATAATCCACCTGGGTACTTCAGCCTTGCGTTTCCACAGCCTTCAG

CCTGTTCTAGAACGATCACTGCCTTACCCCTGCTGCTGCAGTGGTGTGAGTCGTTTCACGGCTGATGTCCCTCGG

GGGATTAAAGGATCTAAAGAGAAAATGGCACCTGGTTGTCTTCGTGCTGTGTCTCATGGGTTTCCATAGTGATAA

AGACAAGGAAACGCTGCAGGGGCCACAGGCACAGGCTGATATTTAAAGATCTTTGCTTGCAGCCCTCCGTCCTGC

TGAAAACCCCCATAAGCCAGTGAACACAGAGCAGCTAGAGGCTCCTCCTCTGCTGGCTTAGGGTCAGAAGTACCT

CACAGTGGTTGTGGACATGGAAGAGTTTTGTCAACACAACACTTTGTCCCCGCTCCGGGAGATGAGTCAGATGGT

GGCTTGAGTTGTCACTTGGTCCCCTCCGCCCCTCGGGTGGCCCCCTTTGCCACGTCCCCTTAGCTTAGTGATCAG

GTGTGAGAGTGGCCATTTCCTTACCTTTGATCCCTGTAAAGCAGAAAGGACTCCTTTGACAGGCGACAAACTACT

GTGGTGAGCAGAATGATTTCCTTTTTCAAGACAACACCTGCCTGGCTTCTATTAATGTGTGCTGGCCATGATATT

GCCCCAAATCCGCCCCACTGAAGTGTTCCCTAAGGAACAGCATTTCTCTGCTCCTCAGTCAACCCCCGTAGCCTA

GAGCAGTGTCACAAGCTTCAGTAAGGCCAGTCAGCTGGAAGTCAGTCTACCGTATAGTAACACTGTATGTCAGTC

TACAGACCACACTCTAGTTGTTTTCCATGAAAGGTATACAAATGAAGAATTTTCTAGCAAAACATGTTTTTAACC

ATCAGTGCTCAATTGCATTTTCTTCCTTTCGCAGCCAGTCAGTCTTTCAAACTATTGACAGTAAGATAATTCTCA

CGTTCACACCTGGTGGCAGGCTTCACTGTAGGGACGGACATTGCAGTTACACCACGATTCCTTCCTCTTCACTGG

CTCGAGGTAAACCCTTTTCAAGGAAAAACAACTCTAGGATTTCTTTTTTCTGTGTACGTAGACCAGTCCCATCAG

TGTATAATCTCTCTCTCACACGCCTCTCTCCAATAGACAGCTTGTATTTGCAGTATTTCATATTTATAAATATGC

GTTTATTTAAAAGGAGAACAAAAGCTTGACTCTGATTCACAGTTTTGTATGTAGCTGGTTTGACGTAGTCTTTTG

TATTTTCCCTGCCGAAGTGAATTGTTGGAGAATGTAAACCGCCTCCACGTGGCGGCAGACTTCCTAAGGCCCCAG

CTCGCTGGCCTCGCGCTGGGCGGCTGGGAATTCCACCTGAGAACAAGTCCCGCAAACCGGGGACGGAAGGACATT

TGACTTTTATTTTTGTATTTAATTGACATGAATGTAAAGGGGACAGCTCAGGGTTGTTTTGGAGCCTGTTGACTT

TGTATCTCTGCCTGTGATTTTCTTTTCTAAATGAAACTCCATGTAGCAACCAGGACGAAGTTGAGAAGGAAAACG

CCAAATGCTTTGGTTATTAGAGTTTAATAGGTAAGCTCTGTTACACTAGGTGTTAGAGTTCCAGAATGTTCTTTT

GTTTGCTAAACCTTGAAGAAACATGTGCCTCAGCCTAGATGTTTTGTCTTCTCTTTTCTGCACTTAATACCTGAC

AGTATGACCGATCTCTGCGCCTTTCTGGGGGCGGGCAAGCTGGCGGTAGATTTGTGATGTCACAGTGCAAACTGC

AGTGACTGTAAATTGGCCTGGCGTGTATAAACGTTTTCAGGGAATGCAGAAGGTATTAATGAAGAGACAAAACCT

TTATTCCATGTGCTTTGCTTCATTCTGTACATAGCTCTTTGGCTCGTGAACCTAATTGTAAACTTTCAGGTATTT

TTGTACAAATAAGGGACTGATGTTCTGTTTCTTGTAATTAGAAATAAACATTAATACAGTGTTCTTCA

>Reverse Complement of SEQ ID NO: 7

SEQ ID NO: 8

TGAAGAACACTGTATTAATGTTTATTTCTAATTACAAGAAACAGAACATCAGTCCCTTATTTGTACAAAAATACC

TGAAAGTTTACAATTAGGTTCACGAGCCAAAGAGCTATGTACAGAATGAAGCAAAGCACATGGAATAAAGGTTTT

GTCTCTTCATTAATACCTTCTGCATTCCCTGAAAACGTTTATACACGCCAGGCCAATTTACAGTCACTGCAGTTT

GCACTGTGACATCACAAATCTACCGCCAGCTTGCCCGCCCCCAGAAAGGCGCAGAGATCGGTCATACTGTCAGGT

ATTAAGTGCAGAAAAGAGAAGACAAAACATCTAGGCTGAGGCACATGTTTCTTCAAGGTTTAGCAAACAAAAGAA

CATTCTGGAACTCTAACACCTAGTGTAACAGAGCTTACCTATTAAACTCTAATAACCAAAGCATTTGGCGTTTTC

CTTCTCAACTTCGTCCTGGTTGCTACATGGAGTTTCATTTAGAAAAGAAAATCACAGGCAGAGATACAAAGTCAA

CAGGCTCCAAAACAACCCTGAGCTGTCCCCTTTACATTCATGTCAATTAAATACAAAAATAAAAGTCAAATGTCC

TTCCGTCCCCGGTTTGCGGGACTTGTTCTCAGGTGGAATTCCCAGCCGCCCAGCGCGAGGCCAGCGAGCTGGGGC

CTTAGGAAGTCTGCCGCCACGTGGAGGCGGTTTACATTCTCCAACAATTCACTTCGGCAGGGAAAATACAAAAGA

-continued

CTACGTCAAACCAGCTACATACAAAACTGTGAATCAGAGTCAAGCTTTTGTTCTCCTTTTAAATAAACGCATATT

TATAAATATGAAATACTGCAAATACAAGCTGTCTATTGGAGAGAGGCGTGTGAGAGAGAGATTATACACTGATGG

GACTGGTCTACGTACACAGAAAAAAGAAATCCTAGAGTTGTTTTTCCTTGAAAAGGGTTTACCTCGAGCCAGTGA

AGAGGAAGGAATCGTGGTGTAACTGCAATGTCCGTCCCTACAGTGAAGCCTGCCACCAGGTGTGAACGTGAGAAT

TATCTTACTGTCAATAGTTTGAAAGACTGACTGGCTGCGAAAGGAAGAAAATGCAATTGAGCACTGATGGTTAAA

AACATGTTTTGCTAGAAAATTCTTCATTTGTATACCTTTCATGGAAAACAACTAGAGTGTGGTCTGTAGACTGAC

ATACAGTGTTACTATACGGTAGACTGACTTCCAGCTGACTGGCCTTACTGAAGCTTGTGACACTGCTCTAGGCTA

CGGGGGTTGACTGAGGAGCAGAGAAATGCTGTTCCTTAGGGAACACTTCAGTGGGGCGGATTTGGGGCAATATCA

TGGCCAGCACACATTAATAGAAGCCAGGCAGGTGTTGTCTTGAAAAAGGAAATCATTCTGCTCACCACAGTAGTT

TGTCGCCTGTCAAAGGAGTCCTTTCTGCTTTACAGGGATCAAAGGTAAGGAAATGGCCACTCTCACACCTGATCA

CTAAGCTAAGGGGACGTGGCAAAGGGGGCCACCCGAGGGGCGGAGGGGACCAAGTGACAACTCAAGCCACCATCT

GACTCATCTCCCGGAGCGGGGACAAAGTGTTGTGTTGACAAAACTCTTCCATGTCCACAACCACTGTGAGGTACT

TCTGACCCTAAGCCAGCAGAGGAGGAGCCTCTAGCTGCTCTGTGTTCACTGGCTTATGGGGGTTTTCAGCAGGAC

GGAGGGCTGCAAGCAAAGATCTTTAAATATCAGCCTGTGCCTGTGGCCCCTGCAGCGTTTCCTTGTCTTTATCAC

TATGGAAACCCATGAGACACAGCACGAAGACAACCAGGTGCCATTTTCTCTTTAGATCCTTTAATCCCCCGAGGG

ACATCAGCCGTGAAACGACTCACACCACTGCAGCAGCAGGGGTAAGGCAGTGATCGTTCTAGAACAGGCTGAAGG

CTGTGGAAACGCAAGGCTGAAGTACCCAGGTGGATTATGCAGCATCCACCGCTGGCCGATGACGGGTGCCAGGTG

TGTCTCAAGGAGGCTGGCCCACGTCAATCTAGAGGCGAGGCCATTCAGCCTGCTGTTTGTGGAACAGTGAATTTT

CCAAAGGAATAAAGTCTCCTGCACTGTGCAGAACAAGACACACTAATAACAAGAGGATCTGACATCTGAGCATAG

AGAAATGATTAACAGACTGTGGTTGCTTGACTGAGTCCACAAAATATGCCAAATGCCTACCACAGTGACACCTTT

TATTTTAACAAGAAAGCTTTTCAAGTATACTGGGAAGGGCTGGGTTTGTCATTTGGGAGCTGAATCCACACCGTG

GTAGTCGGCAGAGGGTGTGGAGGACCCTCTGGGAACATTTGGGGACCCATATTCAGTTTGAAATCTGCCCATTCA

AAACTCTTTCTGTATTATATGAGTTGAAACGCCACATCCCCCTCCTACAATAGGCTGAATACAATATTGAAAACA

AAGAAGGAGTGCAAAAAAGTGATCAATACAAAAAAAGTAAACATATCAGTTTTAATTGTCAAGATTATTCCAGGG

CAAGAGTTCATTTCCAATCACTTCTCTCCGGTTCTTGTTCCTAAGCGGCCCAAGCCAAGATGATCATTCCAGTTT

ATTTTCAACTTTCCGCTGGATCTTCCATGCCCTCCCCAATTTGGCCGATGCAGAGGGAGGCGACCCTGCTGGGTT

CACAGCAGCAAATCGTCGTTTAAGTCCAACAAACTAGTCAATCTTGGTCGGCTGGCACCGAACAAACCCATCTCG

CTCTGGGTCCCCAGGTGCAGAATCGATGTGTGTTCTTCACCAACGCACAGACCGCTTCTTCACTCCAGTGTTCAC

TTCCTCCAGTCTTCAGCCGAGAGGACATCTGCGGTCATAAGGCCACTCGGATGCAGTGGTGCTTGAGTTTGCAAG

GCAGGACTCCTTTGTTCAGCTGGTAAAAGTCAACCAGCTGGATCAGGTCAGAGAATTTGGTGTTCCCGTCATCTA

GGCTGAAGAACGTCTGCCCGTCGTCCTCGCAAGGTAAGATCTGGAAATTTTTAATTTTCTGGTGATGACACAGTG

TGAGTACAAATGCCTTTGGATTACTCTGGCTGTCACGGAGGAGAAAAAGCCCATCCACGAGCCCTTGCTGTTTAA

TGATCCTGTGGGATTCCTCCCTGGAGATCCTCCCGTGAAACCAGTGCTGTGTCCTGTGAATCACTGTACTTAGGG

TAGAAGGGTGGAGGGGACTTTGGCTACCTAGGATGTTCATCCGTGTGCTTCGCTTCCTCCAGGCGTGGCCCTCCT

CCAGGGCTGCGCTCTGGGCCTCTGCCGGATTCTCTATCACGCGTCCTGTTTGCCCAGAAAAATCCATTGCCACGA

GGGAGTTCTCGGAGACACTGCGCACTGGCGTCGAGAACGGGGACAGCAAGGCCTTCCTCTGCTGAGGGATTCGGT

AATTCTGGTAAAGGAGCATTCCATACTTGAGGAGTCTGAACGCTGTCATCCAGCACGTCCTGGTTTGCTCGTCCT

CTGCACAGAGCAACCTCAGCTCTTTAGTTTCATTCCTGACTTTGTTTGGCTTTATGCAGAGCCCGTGGTCTGTAG

GGGCGTTGTACTGCTTCCTGCCAGCGATCAGGGAGAAGATGTTGCTGTCCTCCAGGTCGGCCAGCAGCTGCAGGT

GTCTGGGTTCCTTTGAAGTTCCCTTGGTGGAGCAATAAAGGCCAGATCTCCGCAAACACACATACAGCTTTTTCC

-continued

ATGATTTCTTTCCCAGCTCTTTCACATGCAAAAACCCTTGAATTTCAGGACAACTACTGGAGTTCAGAAAATTCT

GCAAAAGCTGGGTTTGACTGCCATTTGACTGCTGGCACCAAGTAACCATCTGTTCTGGGAAGAAATTCATGGGAT

TTTTAAAGAACTCGTATTTTGCGTAATTCTTCCTGAATAGAAATTTACTCTCACTGGCCATGGTACTCTCCACCT

GGACCACCAGCTCATGGTCTTCCAAGCACCTCTCTAATCCTAGGTGCGGGTGGTGCTCCACTAGTGTCCAGCTGT

TGTCATCCACACAGTGACTTTTGTAAACCAGCAATTGGCACAGGTCTCTGGCTGTCATGTCTGCTAGAATCTCCA

CCACTTTGCTTGTCCCATCTTCACTAAAGACTTTAACATCCTGCTTTGCGGCGGCCTGGCTCGGAGGTAAAGAAC

CCGGCGTGAGCACAGGGGGGCTCCCAGGGCCACAGAGTTCAGGAAAAGGATTGGGGATGGCCGGCAGAGATGAGG

TTCTAAACTGCTGGTCTTCCTCCTGAAGGCGCCTGACAGCGAGGATGTGCACAGGCTGGGAGCGCTGCACCCTCT

GCCTCGGGGACACCTGTGGCTGGATGGACCGAGGAGGGCCTGAAGCCCGAGGCTGGCTGCGGGCATGCTGGCCAT

TCTGCAGGAGGGGCACCGTGTCTGACTGCATGCTGCAGGCCGAGTACAGGCTCTCCAGGGATGCATTCATATCGT

TCACCAGGGCTTCCAGGTCCACATCATCCTCCTGGTGATTCGCAAGTCGGTCAGACTGTGCGGGGAGTCCTGGTC

CTGCCGGGTCTTGTTGACTGCGAGGTGTCTGCTCCACCTTGTCCTGTCAGGAGTTGGCTCTGTAGCACTGTCTGC

TGGGGCGGCCACCCTGGCTTCACTGAGAGGACCCAGGTGAGGACCTGGCTGCCGGTCACTGGGCTGCTGGTCACT

GAGCTACCAGTCACTGGGCCTGCAGCTGCTGCTTCCTGCTCAGCATTGTGGTCAGCGCCAAAGCTGCCGCGCGCG

GCTCCCCGCCGCCTCCGCGTGGCTGCGGGCGACACTCGGCGTGGCCGGCGGCGGGCGCGGGTCCCCGCGGGGCGA

GGCCGGCGCTCAAGACTGTCCCGGGCGCCCCGCGCCGCCGGCGCTGCCGCCACCCAGGGGCTGCGCGGAAACTTT

GGGCTCCACCGGGTCTCCGAGCGCCGAGCCCGCCCGGCCGCAGCTCGCTTCCCTCTCTGCCTCCTCCC

>NM_001350815.2 *Homo sapiens* growth factor receptor bound protein 10 (GRB10), transcript variant 5, mRNA

SEQ ID NO: 9

AGACGCCGGCGGCTCGCGGGCTGTGGCGGGGGCTGCGGTCAAGGCCGCGCTCCTGGGGGCCGCCGCCTGGGAGGG

TGGGCGCCCAGGCGTCCCTGCAGCCCCGGGTGCTCCGACTGCGCGGCGGGGCCGCGGCGCGCGCGCCCGGGCGTC

CGGGCGTCCGGGACAGTGGTGCCAGACACTCCCAAATCCCGAGCCGGCCCAGCCTCGTACGGAGGACCTTTTTTT

TGGTTCTGTTGGTGACCCGTTAGCCGCCGCTGGGGCCTAACACCAAGTTGAGGGCTCGCGGATTAGCCGCCCGCC

AGCCGTGGAAATGTGATAAGAGCGGTACCGTTTGCAGAAGGAAATTTCTGATGCAACTCTTCGCCTTTGCTGATT

GCCTCTCCAAACGCCTGCCTGACGACTGCCTTGGAGCATGTGCGTTATGGAAATTAGGCTTTGGCGCTGACCACA

ATGCTGAGCAGGAAGCAGCAGCTGCAGGCCCAGTGACTGGTAGCTCAGTGACCAGCAGCCCAGTGACCGGCAGCC

AGGTCCTCACCTGGGTCCTCTCAGTGAAGCCAGGGTGGCCGCCCCAGCAGACAGTGCTACAGAGCCAACTCCTGA

CAGAGGATGATGTGGACCTGGAAGCCCTGGTGAACGATATGAATGCATCCCTGGAGAGCCTGTACTCGGCCTGCA

GCATGCAGTCAGACACGGTGCCCCTCCTGCAGAATGGCCAGCATGCCCGCAGCCAGCCTCGGGCTTCAGGCCCTC

CTCGGTCCATCCAGCCACAGGTGTCCCCGAGGCAGAGGGTGCAGCGCTCCCAGCCTGTGCACATCCTCGCTGTCA

GGCGCCTTCAGGAGGAAGACCAGCAGTTTAGAACCTCATCTCTGCCGGCCATCCCCAATCCTTTTCCTGAACTCT

GTGGCCCTGGGAGCCCCCCTGTGCTCACGCCGGGTTCTTTACCTCCGAGCCAGGCCGCCGCAAAGCAGGATGTTA

AAGTCTTTAGTGAAGATGGGACAAGCAAAGTGGTGGAGATTCTAGCAGACATGACAGCCAGAGACCTGTGCCAAT

TGCTGGTTTACAAAAGTCACTGTGTGGATGACAACAGCTGGACACTAGTGGAGCACCACCCGCACCTAGGATTAG

AGAGGTGCTTGGAAGACCATGAGCTGGTGGTCCAGGTGGAGAGTACCATGGCCAGTGAGAGTAAATTTCTATTCA

GGAAGAATTACGCAAAATACGAGTTCTTTAAAAATCCCATGAATTTCTTCCCAGAACAGATGGTTACTTGGTGCC

AGCAGTCAAATGGCAGTCAAACCCAGCTTTTGCAGAATTTTCTGAACTCCAGTAGTTGTCCTGAAATTCAAGGGT

TTTTGCATGTGAAAGAGCTGGGAAAGAAATCATGGAAAAAGCTGTATGTGTGTTTGCGGAGATCTGGCCTTTATT

GCTCCACCAAGGGAACTTCAAAGGAACCCAGACACCTGCAGCTGCTGGCCGACCTGGAGGACAGCAACATCTTCT

CCCTGATCGCTGGCAGGAAGCAGTACAACGCCCCTACAGACCACGGGCTCTGCATAAAGCCAAACAAAGTCAGGA

ATGAAACTAAAGAGCTGAGGTTGCTCTGTGCAGAGGACGAGCAAACCAGGACGTGCTGGATGACAGCGTTCAGAC

-continued

TCCTCAAGTATGGAATGCTCCTTTACCAGAATTACCGAATCCCTCAGCAGAGGAAGGCCTTGCTGTCCCCGTTCT

CGACGCCAGTGCGCAGTGTCTCCGAGAACTCCCTCGTGGCAATGGATTTTTCTGGGCAAACAGGACGCGTGATAG

AGAATCCGGCAGAGGCCCAGAGCGCAGCCCTGGAGGAGGGCCACGCCTGGAGGAAGCGAAGCACACGGATGAACA

TCCTAGGTAGCCAAAGTCCCCTCCACCCTTCTACCCTAAGTACAGTGATTCACAGGACACAGCACTGGTTTCACG

GGAGGATCTCCAGGGAGGAATCCCACAGGATCATTAAACAGCAAGGGCTCGTGGATGGGCTTTTTCTCCTCCGTG

ACAGCCAGAGTAATCCAAAGGCATTTGTACTCACACTGTGTCATCACCAGAAAATTAAAAATTTCCAGATCTTAC

CTTGCGAGGACGACGGGCAGACGTTCTTCAGCCTAGATGACGGGAACACCAAATTCTCTGACCTGATCCAGCTGG

TTGACTTTTACCAGCTGAACAAAGGAGTCCTGCCTTGCAAACTCAAGCACCACTGCATCCGAGTGGCCTTATGAC

CGCAGATGTCCTCTCGGCTGAAGACTGGAGGAAGTGAACACTGGAGTGAAGAAGCGGTCTGTGCGTTGGTGAAGA

ACACACATCGATTCTGCACCTGGGGACCCAGAGCGAGATGGGTTTGTTCGGTGCCAGCCGACCAAGATTGACTAG

TTTGTTGGACTTAAACGACGATTTGCTGCTGTGAACCCAGCAGGGTCGCCTCCCTCTGCATCGGCCAAATTGGGG

AGGGCATGGAAGATCCAGCGGAAAGTTGAAAATAAACTGGAATGATCATCTTGGCTTGGGCCGCTTAGGAACAAG

AACCGGAGAGAAGTGATTGGAAATGAACTCTTGCCCTGGAATAATCTTGACAATTAAAACTGATATGTTTACTTT

TTTTGTATTGATCACTTTTTTGCACTCCTTCTTTGTTTTCAATATTGTATTCAGCCTATTGTAGGAGGGGGATGT

GGCGTTTCAACTCATATAATACAGAAAGAGTTTTGAATGGGCAGATTTCAAACTGAATATGGGTCCCCAAATGTT

CCCAGAGGGTCCTCCACACCCTCTGCCGACTACCACGGTGTGGATTCAGCTCCCAAATGACAAACCCAGCCCTTC

CCAGTATACTTGAAAAGCTTTCTTGTTAAAATAAAAGGTGTCACTGTGGTAGGCATTTGGCATATTTTGTGGACT

CAGTCAAGCAACCACAGTCTGTTAATCATTTCTCTATGCTCAGATGTCAGATCCTCTTGTTATTAGTGTGTCTTG

TTCTGCACAGTGCAGGAGACTTTATTCCTTTGGAAAATTCACTGTTCCACAAACAGCAGGCTGAATGGCCTCGCC

TCTAGATTGACGTGGGCCAGCCTCCTTGAGACACACCTGGCACCCGTCATCGGCCAGCGGTGGATGCTGCATAAT

CCACCTGGGTACTTCAGCCTTGCGTTTCCACAGCCTTCAGCCTGTTCTAGAACGATCACTGCCTTACCCCTGCTG

CTGCAGTGGTGTGAGTCGTTTCACGGCTGATGTCCCTCGGGGGATTAAAGGATCTAAAGAGAAAATGGCACCTGG

TTGTCTTCGTGCTGTGTCTCATGGGTTTCCATAGTGATAAAGACAAGGAAACGCTGCAGGGGCCACAGGCACAGG

CTGATATTTAAAGATCTTTGCTTGCAGCCCTCCGTCCTGCTGAAAACCCCCATAAGCCAGTGAACACAGAGCAGC

TAGAGGCTCCTCCTCTGCTGGCTTAGGGTCAGAAGTACCTCACAGTGGTTGTGGACATGGAAGAGTTTTGTCAAC

ACAACACTTTGTCCCCGCTCCGGGAGATGAGTCAGATGGTGGCTTGAGTTGTCACTTGGTCCCCTCCGCCCCTCG

GGTGGCCCCCTTTGCCACGTCCCCTTAGCTTAGTGATCAGGTGTGAGAGTGGCCATTTCCTTACCTTTGATCCCT

GTAAAGCAGAAAGGACTCCTTTGACAGGCGACAAACTACTGTGGTGAGCAGAATGATTTCCTTTTTCAAGACAAC

ACCTGCCTGGCTTCTATTAATGTGTGCTGGCCATGATATTGCCCCAAATCCGCCCCACTGAAGTGTTCCCTAAGG

AACAGCATTTCTCTGCTCCTCAGTCAACCCCCGTAGCCTAGAGCAGTGTCACAAGCTTCAGTAAGGCCAGTCAGC

TGGAAGTCAGTCTACCGTATAGTAACACTGTATGTCAGTCTACAGACCACACTCTAGTTGTTTTCCATGAAAGGT

ATACAAATGAAGAATTTTCTAGCAAAACATGTTTTTAACCATCAGTGCTCAATTGCATTTTCTTCCTTTCGCAGC

CAGTCAGTCTTTCAAACTATTGACAGTAAGATAATTCTCACGTTCACACCTGGTGGCAGGCTTCACTGTAGGGAC

GGACATTGCAGTTACACCACGATTCCTTCCTCTTCACTGGCTCGAGGTAAACCCTTTTCAAGGAAAAACAACTCT

AGGATTTCTTTTTTCTGTGTACGTAGACCAGTCCCATCAGTGTATAATCTCTCTCTCACACGCCTCTCTCCAATA

GACAGCTTGTATTTGCAGTATTTCATATTTATAAATATGCGTTTATTTAAAAGGAGAACAAAAGCTTGACTCTGA

TTCACAGTTTTGTATGTAGCTGGTTTGACGTAGTCTTTTGTATTTTCCCTGCCGAAGTGAATTGTTGGAGAATGT

AAACCGCCTCCACGTGGCGGCAGACTTCCTAAGGCCCCAGCTCGCTGGCCTCGCGCTGGGCGGCTGGGAATTCCA

CCTGAGAACAAGTCCCGCAAACCGGGGACGGAAGGACATTTGACTTTTATTTTTGTATTTAATTGACATGAATGT

AAAGGGGACAGCTCAGGGTTGTTTTGGAGCCTGTTGACTTTGTATCTCTGCCTGTGATTTTCTTTTCTAAATGAA

ACTCCATGTAGCAACCAGGACGAAGTTGAGAAGGAAAACGCCAAATGCTTTGGTTATTAGAGTTTAATAGGTAAG

-continued

CTCTGTTACACTAGGTGTTAGAGTTCCAGAATGTTCTTTTGTTTGCTAAACCTTGAAGAAACATGTGCCTCAGCC

TAGATGTTTTGTCTTCTCTTTTCTGCACTTAATACCTGACAGTATGACCGATCTCTGCGCCTTTCTGGGGGCGGG

CAAGCTGGCGGTAGATTTGTGATGTCACAGTGCAAACTGCAGTGACTGTAAATTGGCCTGGCGTGTATAAACGTT

TTCAGGGAATGCAGAAGGTATTAATGAAGAGACAAAACCTTTATTCCATGTGCTTTGCTTCATTCTGTACATAGC

TCTTTGGCTCGTGAACCTAATTGTAAACTTTCAGGTATTTTTGTACAAATAAGGGACTGATGTTCTGTTTCTTGT

AATTAGAAATAAACATTAATACAGTGTTCTTCA

>Reverse Complement of SEQ ID NO: 9

SEQ ID NO: 10

TGAAGAACACTGTATTAATGTTTATTTCTAATTACAAGAAACAGAACATCAGTCCCTTATTTGTACAAAAATACC

TGAAAGTTTACAATTAGGTTCACGAGCCAAAGAGCTATGTACAGAATGAAGCAAAGCACATGGAATAAAGGTTTT

GTCTCTTCATTAATACCTTCTGCATTCCCTGAAAACGTTTATACACGCCAGGCCAATTTACAGTCACTGCAGTTT

GCACTGTGACATCACAAATCTACCGCCAGCTTGCCCGCCCCCAGAAAGGCGCAGAGATCGGTCATACTGTCAGGT

ATTAAGTGCAGAAAAGAGAAGACAAAACATCTAGGCTGAGGCACATGTTTCTTCAAGGTTTAGCAAACAAAAGAA

CATTCTGGAACTCTAACACCTAGTGTAACAGAGCTTACCTATTAAACTCTAATAACCAAAGCATTTGGCGTTTTC

CTTCTCAACTTCGTCCTGGTTGCTACATGGAGTTTCATTTAGAAAAGAAAATCACAGGCAGAGATACAAAGTCAA

CAGGCTCCAAAACAACCCTGAGCTGTCCCCTTTACATTCATGTCAATTAAATACAAAAATAAAAGTCAAATGTCC

TTCCGTCCCCGGTTTGCGGGACTTGTTCTCAGGTGGAATTCCCAGCCGCCCAGCGCGAGGCCAGCGAGCTGGGGC

CTTAGGAAGTCTGCCGCCACGTGGAGGCGGTTTACATTCTCCAACAATTCACTTCGGCAGGGAAAATACAAAAGA

CTACGTCAAACCAGCTACATACAAAACTGTGAATCAGAGTCAAGCTTTTGTTCTCCTTTTAAATAAACGCATATT

TATAAATATGAAATACTGCAAATACAAGCTGTCTATTGGAGAGAGGCGTGTGAGAGAGAGATTATACACTGATGG

GACTGGTCTACGTACACAGAAAAAAGAAATCCTAGAGTTGTTTTTCCTTGAAAAGGGTTTACCTCGAGCCAGTGA

AGAGGAAGGAATCGTGGTGTAACTGCAATGTCCGTCCCTACAGTGAAGCCTGCCACCAGGTGTGAACGTGAGAAT

TATCTTACTGTCAATAGTTTGAAAGACTGACTGGCTGCGAAAGGAAGAAAATGCAATTGAGCACTGATGGTTAAA

AACATGTTTTGCTAGAAAATTCTTCATTTGTATACCTTTCATGGAAAACAACTAGAGTGTGGTCTGTAGACTGAC

ATACAGTGTTACTATACGGTAGACTGACTTCCAGCTGACTGGCCTTACTGAAGCTTGTGACACTGCTCTAGGCTA

CGGGGGTTGACTGAGGAGCAGAGAAATGCTGTTCCTTAGGGAACACTTCAGTGGGGCGGATTTGGGGCAATATCA

TGGCCAGCACACATTAATAGAAGCCAGGCAGGTGTTGTCTTGAAAAAGGAAATCATTCTGCTCACCACAGTAGTT

TGTCGCCTGTCAAAGGAGTCCTTTCTGCTTTACAGGGATCAAAGGTAAGGAAATGGCCACTCTCACACCTGATCA

CTAAGCTAAGGGGACGTGGCAAAGGGGGCCACCCGAGGGGCGGAGGGGACCAAGTGACAACTCAAGCCACCATCT

GACTCATCTCCCGGAGCGGGGACAAAGTGTTGTGTTGACAAAACTCTTCCATGTCCACAACCACTGTGAGGTACT

TCTGACCCTAAGCCAGCAGAGGAGGAGCCTCTAGCTGCTCTGTGTTCACTGGCTTATGGGGGTTTTCAGCAGGAC

GGAGGGCTGCAAGCAAAGATCTTTAAATATCAGCCTGTGCCTGTGGCCCCTGCAGCGTTTCCTTGTCTTTATCAC

TATGGAAACCCATGAGACACAGCACGAAGACAACCAGGTGCCATTTTCTCTTTAGATCCTTTAATCCCCCGAGGG

ACATCAGCCGTGAAACGACTCACACCACTGCAGCAGCAGGGGTAAGGCAGTGATCGTTCTAGAACAGGCTGAAGG

CTGTGGAAACGCAAGGCTGAAGTACCCAGGTGGATTATGCAGCATCCACCGCTGGCCGATGACGGGTGCCAGGTG

TGTCTCAAGGAGGCTGGCCCACGTCAATCTAGAGGCGAGGCCATTCAGCCTGCTGTTTGTGGAACAGTGAATTTT

CCAAAGGAATAAAGTCTCCTGCACTGTGCAGAACAAGACACACTAATAACAAGAGGATCTGACATCTGAGCATAG

AGAAATGATTAACAGACTGTGGTTGCTTGACTGAGTCCACAAAATATGCCAAATGCCTACCACAGTGACACCTTT

TATTTTAACAAGAAAGCTTTTCAAGTATACTGGGAAGGGCTGGGTTTGTCATTTGGGAGCTGAATCCACACCGTG

GTAGTCGGCAGAGGGTGTGGAGGACCCTCTGGGAACATTTGGGGACCCATATTCAGTTTGAAATCTGCCCATTCA

AAACTCTTTCTGTATTATATGAGTTGAAACGCCACATCCCCCTCCTACAATAGGCTGAATACAATATTGAAAACA

-continued

AAGAAGGAGTGCAAAAAAGTGATCAATACAAAAAAAGTAAACATATCAGTTTTAATTGTCAAGATTATTCCAGGG

CAAGAGTTCATTTCCAATCACTTCTCTCCGGTTCTTGTTCCTAAGCGGCCCAAGCCAAGATGATCATTCCAGTTT

ATTTTCAACTTTCCGCTGGATCTTCCATGCCCTCCCCAATTTGGCCGATGCAGAGGGAGGCGACCCTGCTGGGTT

CACAGCAGCAAATCGTCGTTTAAGTCCAACAAACTAGTCAATCTTGGTCGGCTGGCACCGAACAAACCCATCTCG

CTCTGGGTCCCCAGGTGCAGAATCGATGTGTGTTCTTCACCAACGCACAGACCGCTTCTTCACTCCAGTGTTCAC

TTCCTCCAGTCTTCAGCCGAGAGGACATCTGCGGTCATAAGGCCACTCGGATGCAGTGGTGCTTGAGTTTGCAAG

GCAGGACTCCTTTGTTCAGCTGGTAAAAGTCAACCAGCTGGATCAGGTCAGAGAATTTGGTGTTCCCGTCATCTA

GGCTGAAGAACGTCTGCCCGTCGTCCTCGCAAGGTAAGATCTGGAAATTTTTAATTTTCTGGTGATGACACAGTG

TGAGTACAAATGCCTTTGGATTACTCTGGCTGTCACGGAGGAGAAAAAGCCCATCCACGAGCCCTTGCTGTTTAA

TGATCCTGTGGGATTCCTCCCTGGAGATCCTCCCGTGAAACCAGTGCTGTGTCCTGTGAATCACTGTACTTAGGG

TAGAAGGGTGGAGGGGACTTTGGCTACCTAGGATGTTCATCCGTGTGCTTCGCTTCCTCCAGGCGTGGCCCTCCT

CCAGGGCTGCGCTCTGGGCCTCTGCCGGATTCTCTATCACGCGTCCTGTTTGCCCAGAAAAATCCATTGCCACGA

GGGAGTTCTCGGAGACACTGCGCACTGGCGTCGAGAACGGGGACAGCAAGGCCTTCCTCTGCTGAGGGATTCGGT

AATTCTGGTAAAGGAGCATTCCATACTTGAGGAGTCTGAACGCTGTCATCCAGCACGTCCTGGTTTGCTCGTCCT

CTGCACAGAGCAACCTCAGCTCTTTAGTTTCATTCCTGACTTTGTTTGGCTTTATGCAGAGCCCGTGGTCTGTAG

GGGCGTTGTACTGCTTCCTGCCAGCGATCAGGGAGAAGATGTTGCTGTCCTCCAGGTCGGCCAGCAGCTGCAGGT

GTCTGGGTTCCTTTGAAGTTCCCTTGGTGGAGCAATAAAGGCCAGATCTCCGCAAACACACATACAGCTTTTTCC

ATGATTTCTTTCCCAGCTCTTTCACATGCAAAAACCCTTGAATTTCAGGACAACTACTGGAGTTCAGAAAATTCT

GCAAAAGCTGGGTTTGACTGCCATTTGACTGCTGGCACCAAGTAACCATCTGTTCTGGGAAGAAATTCATGGGAT

TTTTAAAGAACTCGTATTTTGCGTAATTCTTCCTGAATAGAAATTTACTCTCACTGGCCATGGTACTCTCCACCT

GGACCACCAGCTCATGGTCTTCCAAGCACCTCTCTAATCCTAGGTGCGGGTGGTGCTCCACTAGTGTCCAGCTGT

TGTCATCCACACAGTGACTTTTGTAAACCAGCAATTGGCACAGGTCTCTGGCTGTCATGTCTGCTAGAATCTCCA

CCACTTTGCTTGTCCCATCTTCACTAAAGACTTTAACATCCTGCTTTGCGGCGGCCTGGCTCGGAGGTAAAGAAC

CCGGCGTGAGCACAGGGGGGCTCCCAGGGCCACAGAGTTCAGGAAAAGGATTGGGGATGGCCGGCAGAGATGAGG

TTCTAAACTGCTGGTCTTCCTCCTGAAGGCGCCTGACAGCGAGGATGTGCACAGGCTGGGAGCGCTGCACCCTCT

GCCTCGGGGACACCTGTGGCTGGATGGACCGAGGAGGGCCTGAAGCCCGAGGCTGGCTGCGGGCATGCTGGCCAT

TCTGCAGGAGGGGCACCGTGTCTGACTGCATGCTGCAGGCCGAGTACAGGCTCTCCAGGGATGCATTCATATCGT

TCACCAGGGCTTCCAGGTCCACATCATCCTCTGTCAGGAGTTGGCTCTGTAGCACTGTCTGCTGGGGCGGCCACC

CTGGCTTCACTGAGAGGACCCAGGTGAGGACCTGGCTGCCGGTCACTGGGCTGCTGGTCACTGAGCTACCAGTCA

CTGGGCCTGCAGCTGCTGCTTCCTGCTCAGCATTGTGGTCAGCGCCAAAGCCTAATTTCCATAACGCACATGCTC

CAAGGCAGTCGTCAGGCAGGCGTTTGGAGAGGCAATCAGCAAAGGCGAAGAGTTGCATCAGAAATTTCCTTCTGC

AAACGGTACCGCTCTTATCACATTTCCACGGCTGGCGGGCGGCTAATCCGCGAGCCCTCAACTTGGTGTTAGGCC

CCAGCGGCGGCTAACGGGTCACCAACAGAACCAAAAAAAAGGTCCTCCGTACGAGGCTGGGCCGGCTCGGGATTT

GGGAGTGTCTGGCACCACTGTCCCGGACGCCCGGACGCCCGGGCGCGCGCGCCGCGGCCCCGCCGCGCAGTCGGA

GCACCCGGGGCTGCAGGGACGCCTGGGCGCCCACCCTCCCAGGCGGCGGCCCCCAGGAGCGCGGCCTTGACCGCA

GCCCCCGCCACAGCCCGCGAGCCGCCGGCGTCT

>NM_001350816.3 *Homo sapiens* growth factor receptor bound protein 10 (GRB10), transcript variant 6, mRNA

SEQ ID NO: 11

AGACGCCGGCGGCTCGCGGGCTGTGGCGGGGGCTGCGGTCAAGGCCGCGCTCCTGGGGGCCGCCGCCTGGGAGGG

TGGGCGCCCAGGCGTCCCTGCAGCCCCGGGTGCTCCGACTGCGCGGCGGGGCCGCGGCGCGCGCGCCCGGGCGTC

CGGGCGTCCGGGACAGTGGTGCCAGACACTCCCAAATCCCGAGCCGGCCCAGCCTCGTACGGAGGACCTTTTTTT

-continued

TGGTTCTGTTGGTGACCCGTTAGCCGCCGCTGGGGCCTAACACCAAGTTGAGGGCTCGCGGATTAGCCGCCCGCC

AGCCGTGGAAATGTGATAAGAGCGGTACCGTTTGCAGAAGGAAATTTCTGATGCAACTCTTCGCCTTTGCTGATT

GCCTCTCCAAACGCCTGCCTGACGACTGCCTTGGAGCATGTGCGTTATGGAAATTAGGCTTTGGCGCTGACCACA

ATGCTGAGCAGGAAGCAGCAGCTGCAGGCCCAGTGACTGGTAGCTCAGTGACCAGCAGCCCAGTGACCGGCAGCC

AGGTCCTCACCTGGGTCCTCTCAGTGAAGCCAGGGTGGCCGCCCCAGCAGACAGTGCTACAGAGCCAACTCCTGA

CAGGTTCTGAAAATATTGTGCACAGGGCAGGCTGAGGACACAGCCACGTGATACCCACTGTAGAGAGAGGGAGAG

AGAGACCTCCTATGCAAGCTGCCGGCCCTCTGTTCCGTAGTAAGGACAAGGTGGAGCAGACACCTCGCAGTCAAC

AAGACCCGGCAGGACCAGGACTCCCCGCACAGTCTGACCGACTTGCGAATCACCAGGAGGATGATGTGGACCTGG

AAGCCCTGGTGAACGATATGAATGCATCCCTGGAGAGCCTGTACTCGGCCTGCAGCATGCAGTCAGACACGGTGC

CCCTCCTGCAGAATGGCCAGCATGCCCGCAGCCAGCCTCGGGCTTCAGGCCCTCCTCGGTCCATCCAGCCACAGG

TGTCCCCGAGGCAGAGGGTGCAGCGCTCCCAGCCTGTGCACATCCTCGCTGTCAGGCGCCTTCAGGAGGAAGACC

AGCAGTTTAGAACCTCATCTCTGCCGGCCATCCCCAATCCTTTTCCTGAACTCTGTGGCCCTGGGAGCCCCCCTG

TGCTCACGCCGGGTTCTTTACCTCCGAGCCAGGCCGCCGCAAAGCAGGATGTTAAAGTCTTTAGTGAAGATGGGA

CAAGCAAAGTGGTGGAGATTCTAGCAGACATGACAGCCAGAGACCTGTGCCAATTGCTGGTTTACAAAAGTCACT

GTGTGGATGACAACAGCTGGACACTAGTGGAGCACCACCCGCACCTAGGATTAGAGAGGTGCTTGGAAGACCATG

AGCTGGTGGTCCAGGTGGAGAGTACCATGGCCAGTGAGAGTAAATTTCTATTCAGGAAGAATTACGCAAAATACG

AGTTCTTTAAAAATCCCATGAATTTCTTCCCAGAACAGATGGTTACTTGGTGCCAGCAGTCAAATGGCAGTCAAA

CCCAGCTTTTGCAGAATTTTCTGAACTCCAGTAGTTGTCCTGAAATTCAAGGGTTTTTGCATGTGAAAGAGCTGG

GAAAGAAATCATGGAAAAAGCTGTATGTGTGTTTGCGGAGATCTGGCCTTTATTGCTCCACCAAGGGAACTTCAA

AGGAACCCAGACACCTGCAGCTGCTGGCCGACCTGGAGGACAGCAACATCTTCTCCCTGATCGCTGGCAGGAAGC

AGTACAACGCCCCTACAGACCACGGGCTCTGCATAAAGCCAAACAAAGTCAGGAATGAAACTAAAGAGCTGAGGT

TGCTCTGTGCAGAGGACGAGCAAACCAGGACGTGCTGGATGACAGCGTTCAGACTCCTCAAGTATGGAATGCTCC

TTTACCAGAATTACCGAATCCCTCAGCAGAGGAAGGCCTTGCTGTCCCCGTTCTCGACGCCAGTGCGCAGTGTCT

CCGAGAACTCCCTCGTGGCAATGGATTTTTCTGGGCAAACAGGACGCGTGATAGAGAATCCGGCAGAGGCCCAGA

GCGCAGCCCTGGAGGAGGGCCACGCCTGGAGGAAGCGAAGCACACGGATGAACATCCTAGGTAGCCAAAGTCCCC

TCCACCCTTCTACCCTAAGTACAGTGATTCACAGGACACAGCACTGGTTTCACGGGAGGATCTCCAGGGAGGAAT

CCCACAGGATCATTAAACAGCAAGGGCTCGTGGATGGGCTTTTTCTCCTCCGTGACAGCCAGAGTAATCCAAAGG

CATTTGTACTCACACTGTGTCATCACCAGAAAATTAAAAATTTCCAGATCTTACCTTGCGAGGACGACGGGCAGA

CGTTCTTCAGCCTAGATGACGGGAACACCAAATTCTCTGACCTGATCCAGCTGGTTGACTTTTACCAGCTGAACA

AAGGAGTCCTGCCTTGCAAACTCAAGCACCACTGCATCCGAGTGGCCTTATGACCGCAGATGTCCTCTCGGCTGA

AGACTGGAGGAAGTGAACACTGGAGTGAAGAAGCGGTCTGTGCGTTGGTGAAGAACACACATCGATTCTGCACCT

GGGGACCCAGAGCGAGATGGGTTTGTTCGGTGCCAGCCGACCAAGATTGACTAGTTTGTTGGACTTAAACGACGA

TTTGCTGCTGTGAACCCAGCAGGGTCGCCTCCCTCTGCATCGGCCAAATTGGGGAGGGCATGGAAGATCCAGCGG

AAAGTTGAAAATAAACTGGAATGATCATCTTGGCTTGGGCCGCTTAGGAACAAGAACCGGAGAGAAGTGATTGGA

AATGAACTCTTGCCCTGGAATAATCTTGACAATTAAAACTGATATGTTTACTTTTTTTGTATTGATCACTTTTTT

GCACTCCTTCTTTGTTTTCAATATTGTATTCAGCCTATTGTAGGAGGGGGATGTGGCGTTTCAACTCATATAATA

CAGAAAGAGTTTTGAATGGGCAGATTTCAAACTGAATATGGGTCCCCAAATGTTCCCAGAGGGTCCTCCACACCC

TCTGCCGACTACCACGGTGTGGATTCAGCTCCCAAATGACAAACCCAGCCCTTCCCAGTATACTTGAAAAGCTTT

CTTGTTAAAATAAAAGGTGTCACTGTGGTAGGCATTTGGCATATTTTGTGGACTCAGTCAAGCAACCACAGTCTG

TTAATCATTTCTCTATGCTCAGATGTCAGATCCTCTTGTTATTAGTGTGTCTTGTTCTGCACAGTGCAGGAGACT

TTATTCCTTTGGAAAATTCACTGTTCCACAAACAGCAGGCTGAATGGCCTCGCCTCTAGATTGACGTGGGCCAGC

-continued

CTCCTTGAGACACACCTGGCACCCGTCATCGGCCAGCGGTGGATGCTGCATAATCCACCTGGGTACTTCAGCCTT

GCGTTTCCACAGCCTTCAGCCTGTTCTAGAACGATCACTGCCTTACCCCTGCTGCTGCAGTGGTGTGAGTCGTTT

CACGGCTGATGTCCCTCGGGGGATTAAAGGATCTAAAGAGAAAATGGCACCTGGTTGTCTTCGTGCTGTGTCTCA

TGGGTTTCCATAGTGATAAAGACAAGGAAACGCTGCAGGGGCCACAGGCACAGGCTGATATTTAAAGATCTTTGC

TTGCAGCCCTCCGTCCTGCTGAAAACCCCCATAAGCCAGTGAACACAGAGCAGCTAGAGGCTCCTCCTCTGCTGG

CTTAGGGTCAGAAGTACCTCACAGTGGTTGTGGACATGGAAGAGTTTTGTCAACACAACACTTTGTCCCCGCTCC

GGGAGATGAGTCAGATGGTGGCTTGAGTTGTCACTTGGTCCCCTCCGCCCCTCGGGTGGCCCCCTTTGCCACGTC

CCCTTAGCTTAGTGATCAGGTGTGAGAGTGGCCATTTCCTTACCTTTGATCCCTGTAAAGCAGAAAGGACTCCTT

TGACAGGCGACAAACTACTGTGGTGAGCAGAATGATTTCCTTTTTCAAGACAACACCTGCCTGGCTTCTATTAAT

GTGTGCTGGCCATGATATTGCCCCAAATCCGCCCCACTGAAGTGTTCCCTAAGGAACAGCATTTCTCTGCTCCTC

AGTCAACCCCCGTAGCCTAGAGCAGTGTCACAAGCTTCAGTAAGGCCAGTCAGCTGGAAGTCAGTCTACCGTATA

GTAACACTGTATGTCAGTCTACAGACCACACTCTAGTTGTTTTCCATGAAAGGTATACAAATGAAGAATTTTCTA

GCAAAACATGTTTTTAACCATCAGTGCTCAATTGCATTTTCTTCCTTTCGCAGCCAGTCAGTCTTTCAAACTATT

GACAGTAAGATAATTCTCACGTTCACACCTGGTGGCAGGCTTCACTGTAGGGACGGACATTGCAGTTACACCACG

ATTCCTTCCTCTTCACTGGCTCGAGGTAAACCCTTTTCAAGGAAAAACAACTCTAGGATTTCTTTTTTCTGTGTA

CGTAGACCAGTCCCATCAGTGTATAATCTCTCTCTCACACGCCTCTCTCCAATAGACAGCTTGTATTTGCAGTAT

TTCATATTTATAAATATGCGTTTATTTAAAAGGAGAACAAAAGCTTGACTCTGATTCACAGTTTTGTATGTAGCT

GGTTTGACGTAGTCTTTTGTATTTTCCCTGCCGAAGTGAATTGTTGGAGAATGTAAACCGCCTCCACGTGGCGGC

AGACTTCCTAAGGCCCCAGCTCGCTGGCCTCGCGCTGGGCGGCTGGGAATTCCACCTGAGAACAAGTCCCGCAAA

CCGGGGACGGAAGGACATTTGACTTTTATTTTTGTATTTAATTGACATGAATGTAAAGGGGACAGCTCAGGGTTG

TTTTGGAGCCTGTTGACTTTGTATCTCTGCCTGTGATTTTCTTTTCTAAATGAAACTCCATGTAGCAACCAGGAC

GAAGTTGAGAAGGAAAACGCCAAATGCTTTGGTTATTAGAGTTTAATAGGTAAGCTCTGTTACACTAGGTGTTAG

AGTTCCAGAATGTTCTTTTGTTTGCTAAACCTTGAAGAAACATGTGCCTCAGCCTAGATGTTTTGTCTTCTCTTT

TCTGCACTTAATACCTGACAGTATGACCGATCTCTGCGCCTTTCTGGGGGCGGGCAAGCTGGCGGTAGATTTGTG

ATGTCACAGTGCAAACTGCAGTGACTGTAAATTGGCCTGGCGTGTATAAACGTTTTCAGGGAATGCAGAAGGTAT

TAATGAAGAGACAAAACCTTTATTCCATGTGCTTTGCTTCATTCTGTACATAGCTCTTTGGCTCGTGAACCTAAT

TGTAAACTTTCAGGTATTTTTGTACAAATAAGGGACTGATGTTCTGTTTCTTGTAATTAGAAATAAACATTAATA

CAGTGTTCTTC

>Reverse Complement of SEQ ID NO: 11

SEQ ID NO: 12

GAAGAACACTGTATTAATGTTTATTTCTAATTACAAGAAACAGAACATCAGTCCCTTATTTGTACAAAAATACCT

GAAAGTTTACAATTAGGTTCACGAGCCAAAGAGCTATGTACAGAATGAAGCAAAGCACATGGAATAAAGGTTTTG

TCTCTTCATTAATACCTTCTGCATTCCCTGAAAACGTTTATACACGCCAGGCCAATTTACAGTCACTGCAGTTTG

CACTGTGACATCACAAATCTACCGCCAGCTTGCCCGCCCCCAGAAAGGCGCAGAGATCGGTCATACTGTCAGGTA

TTAAGTGCAGAAAAGAGAAGACAAAACATCTAGGCTGAGGCACATGTTTCTTCAAGGTTTAGCAAACAAAAGAAC

ATTCTGGAACTCTAACACCTAGTGTAACAGAGCTTACCTATTAAACTCTAATAACCAAAGCATTTGGCGTTTTCC

TTCTCAACTTCGTCCTGGTTGCTACATGGAGTTTCATTTAGAAAAGAAAATCACAGGCAGAGATACAAAGTCAAC

AGGCTCCAAAACAACCCTGAGCTGTCCCCTTTACATTCATGTCAATTAAATACAAAAATAAAAGTCAAATGTCCT

TCCGTCCCCGGTTTGCGGGACTTGTTCTCAGGTGGAATTCCCAGCCGCCCAGCGCGAGGCCAGCGAGCTGGGGCC

TTAGGAAGTCTGCCGCCACGTGGAGGCGGTTTACATTCTCCAACAATTCACTTCGGCAGGGAAAATACAAAAGAC

TACGTCAAACCAGCTACATACAAAACTGTGAATCAGAGTCAAGCTTTTGTTCTCCTTTTAAATAAACGCATATTT

-continued

ATAAATATGAAATACTGCAAATACAAGCTGTCTATTGGAGAGAGGCGTGTGAGAGAGAGATTATACACTGATGGG

ACTGGTCTACGTACACAGAAAAAAGAAATCCTAGAGTTGTTTTTCCTTGAAAAGGGTTTACCTCGAGCCAGTGAA

GAGGAAGGAATCGTGGTGTAACTGCAATGTCCGTCCCTACAGTGAAGCCTGCCACCAGGTGTGAACGTGAGAATT

ATCTTACTGTCAATAGTTTGAAAGACTGACTGGCTGCGAAAGGAAGAAAATGCAATTGAGCACTGATGGTTAAAA

ACATGTTTTGCTAGAAAATTCTTCATTTGTATACCTTTCATGGAAAACAACTAGAGTGTGGTCTGTAGACTGACA

TACAGTGTTACTATACGGTAGACTGACTTCCAGCTGACTGGCCTTACTGAAGCTTGTGACACTGCTCTAGGCTAC

GGGGGTTGACTGAGGAGCAGAGAAATGCTGTTCCTTAGGGAACACTTCAGTGGGGCGGATTTGGGGCAATATCAT

GGCCAGCACACATTAATAGAAGCCAGGCAGGTGTTGTCTTGAAAAAGGAAATCATTCTGCTCACCACAGTAGTTT

GTCGCCTGTCAAAGGAGTCCTTTCTGCTTTACAGGGATCAAAGGTAAGGAAATGGCCACTCTCACACCTGATCAC

TAAGCTAAGGGGACGTGGCAAAGGGGGCCACCCGAGGGGCGGAGGGGACCAAGTGACAACTCAAGCCACCATCTG

ACTCATCTCCCGGAGCGGGGACAAAGTGTTGTGTTGACAAAACTCTTCCATGTCCACAACCACTGTGAGGTACTT

CTGACCCTAAGCCAGCAGAGGAGGAGCCTCTAGCTGCTCTGTGTTCACTGGCTTATGGGGGTTTTCAGCAGGACG

GAGGGCTGCAAGCAAAGATCTTTAAATATCAGCCTGTGCCTGTGGCCCCTGCAGCGTTTCCTTGTCTTTATCACT

ATGGAAACCCATGAGACACAGCACGAAGACAACCAGGTGCCATTTTCTCTTTAGATCCTTTAATCCCCCGAGGGA

CATCAGCCGTGAAACGACTCACACCACTGCAGCAGCAGGGGTAAGGCAGTGATCGTTCTAGAACAGGCTGAAGGC

TGTGGAAACGCAAGGCTGAAGTACCCAGGTGGATTATGCAGCATCCACCGCTGGCCGATGACGGGTGCCAGGTGT

GTCTCAAGGAGGCTGGCCCACGTCAATCTAGAGGCGAGGCCATTCAGCCTGCTGTTTGTGGAACAGTGAATTTTC

CAAAGGAATAAAGTCTCCTGCACTGTGCAGAACAAGACACACTAATAACAAGAGGATCTGACATCTGAGCATAGA

GAAATGATTAACAGACTGTGGTTGCTTGACTGAGTCCACAAAATATGCCAAATGCCTACCACAGTGACACCTTTT

ATTTTAACAAGAAAGCTTTTCAAGTATACTGGGAAGGGCTGGGTTTGTCATTTGGGAGCTGAATCCACACCGTGG

TAGTCGGCAGAGGGTGTGGAGGACCCTCTGGGAACATTTGGGGACCCATATTCAGTTTGAAATCTGCCCATTCAA

AACTCTTTCTGTATTATATGAGTTGAAACGCCACATCCCCCTCCTACAATAGGCTGAATACAATATTGAAAACAA

AGAAGGAGTGCAAAAAAGTGATCAATACAAAAAAAGTAAACATATCAGTTTTAATTGTCAAGATTATTCCAGGGC

AAGAGTTCATTTCCAATCACTTCTCTCCGGTTCTTGTTCCTAAGCGGCCCAAGCCAAGATGATCATTCCAGTTTA

TTTTCAACTTTCCGCTGGATCTTCCATGCCCTCCCCAATTTGGCCGATGCAGAGGGAGGCGACCCTGCTGGGTTC

ACAGCAGCAAATCGTCGTTTAAGTCCAACAAACTAGTCAATCTTGGTCGGCTGGCACCGAACAAACCCATCTCGC

TCTGGGTCCCCAGGTGCAGAATCGATGTGTGTTCTTCACCAACGCACAGACCGCTTCTTCACTCCAGTGTTCACT

TCCTCCAGTCTTCAGCCGAGAGGACATCTGCGGTCATAAGGCCACTCGGATGCAGTGGTGCTTGAGTTTGCAAGG

CAGGACTCCTTTGTTCAGCTGGTAAAAGTCAACCAGCTGGATCAGGTCAGAGAATTTGGTGTTCCCGTCATCTAG

GCTGAAGAACGTCTGCCCGTCGTCCTCGCAAGGTAAGATCTGGAAATTTTTAATTTTCTGGTGATGACACAGTGT

GAGTACAAATGCCTTTGGATTACTCTGGCTGTCACGGAGGAGAAAAAGCCCATCCACGAGCCCTTGCTGTTTAAT

GATCCTGTGGGATTCCTCCCTGGAGATCCTCCCGTGAAACCAGTGCTGTGTCCTGTGAATCACTGTACTTAGGGT

AGAAGGGTGGAGGGGACTTTGGCTACCTAGGATGTTCATCCGTGTGCTTCGCTTCCTCCAGGCGTGGCCCTCCTC

CAGGGCTGCGCTCTGGGCCTCTGCCGGATTCTCTATCACGCGTCCTGTTTGCCCAGAAAAATCCATTGCCACGAG

GGAGTTCTCGGAGACACTGCGCACTGGCGTCGAGAACGGGGACAGCAAGGCCTTCCTCTGCTGAGGGATTCGGTA

ATTCTGGTAAAGGAGCATTCCATACTTGAGGAGTCTGAACGCTGTCATCCAGCACGTCCTGGTTTGCTCGTCCTC

TGCACAGAGCAACCTCAGCTCTTTAGTTTCATTCCTGACTTTGTTTGGCTTTATGCAGAGCCCGTGGTCTGTAGG

GGCGTTGTACTGCTTCCTGCCAGCGATCAGGGAGAAGATGTTGCTGTCCTCCAGGTCGGCCAGCAGCTGCAGGTG

TCTGGGTTCCTTTGAAGTTCCCTTGGTGGAGCAATAAAGGCCAGATCTCCGCAAACACACATACAGCTTTTTCCA

TGATTTCTTTCCCAGCTCTTTCACATGCAAAAACCCTTGAATTTCAGGACAACTACTGGAGTTCAGAAAATTCTG

CAAAAGCTGGGTTTGACTGCCATTTGACTGCTGGCACCAAGTAACCATCTGTTCTGGGAAGAAATTCATGGGATT

-continued

TTTAAAGAACTCGTATTTTGCGTAATTCTTCCTGAATAGAAATTTACTCTCACTGGCCATGGTACTCTCCACCTG

GACCACCAGCTCATGGTCTTCCAAGCACCTCTCTAATCCTAGGTGCGGGTGGTGCTCCACTAGTGTCCAGCTGTT

GTCATCCACACAGTGACTTTTGTAAACCAGCAATTGGCACAGGTCTCTGGCTGTCATGTCTGCTAGAATCTCCAC

CACTTTGCTTGTCCCATCTTCACTAAAGACTTTAACATCCTGCTTTGCGGCGGCCTGGCTCGGAGGTAAAGAACC

CGGCGTGAGCACAGGGGGGCTCCCAGGGCCACAGAGTTCAGGAAAAGGATTGGGGATGGCCGGCAGAGATGAGGT

TCTAAACTGCTGGTCTTCCTCCTGAAGGCGCCTGACAGCGAGGATGTGCACAGGCTGGGAGCGCTGCACCCTCTG

CCTCGGGGACACCTGTGGCTGGATGGACCGAGGAGGGCCTGAAGCCCGAGGCTGGCTGCGGGCATGCTGGCCATT

CTGCAGGAGGGGCACCGTGTCTGACTGCATGCTGCAGGCCGAGTACAGGCTCTCCAGGGATGCATTCATATCGTT

CACCAGGGCTTCCAGGTCCACATCATCCTCCTGGTGATTCGCAAGTCGGTCAGACTGTGCGGGGAGTCCTGGTCC

TGCCGGGTCTTGTTGACTGCGAGGTGTCTGCTCCACCTTGTCCTTACTACGGAACAGAGGGCCGGCAGCTTGCAT

AGGAGGTCTCTCTCCCTCTCTCTACAGTGGGTATCACGTGGCTGTGTCCTCAGCCTGCCCTGTGCACAATATT

TTCAGAACCTGTCAGGAGTTGGCTCTGTAGCACTGTCTGCTGGGGCGGCCACCCTGGCTTCACTGAGAGGACCCA

GGTGAGGACCTGGCTGCCGGTCACTGGGCTGCTGGTCACTGAGCTACCAGTCACTGGGCCTGCAGCTGCTGCTTC

CTGCTCAGCATTGTGGTCAGCGCCAAAGCCTAATTTCCATAACGCACATGCTCCAAGGCAGTCGTCAGGCAGGCG

TTTGGAGAGGCAATCAGCAAAGGCGAAGAGTTGCATCAGAAATTTCCTTCTGCAAACGGTACCGCTCTTATCACA

TTTCCACGGCTGGCGGGCGGCTAATCCGCGAGCCCTCAACTTGGTGTTAGGCCCCAGCGGCGGCTAACGGGTCAC

CAACAGAACCAAAAAAAAGGTCCTCCGTACGAGGCTGGGCCGGCTCGGGATTTGGGAGTGTCTGGCACCACTGTC

CCGGACGCCCGGACGCCCGGGCGCGCGCGCCCGCGGCCCCGCCGCGCAGTCGGAGCACCCGGGGCTGCAGGGACGC

CTGGGCGCCCACCCTCCCAGGCGGCGGCCCCCAGGAGCGCGGCCTTGACCGCAGCCCCCGCCACAGCCCGCGAGC

CGCCGGCGTCT

>NM_001371008.1 *Homo sapiens* growth factor receptor bound protein 10
(GRB10), transcript variant 7, mRNA

SEQ ID NO: 13

GGGAGGAGGCAGAGAGGGAAGCGAGCTGCGGCCGGGCGGGCTCGGCGCTCGGAGACCCGGTGGAGCCCAAAGTTT

CCGCGCAGCCCCTGGGTGGCGGCAGCGCCGGCGGCGCGGGGCGCCCGGGACAGTCTTGAGCGCCGGCCTCGCCCC

GCGGGGACCCGCGCCCGCCGCCGGCCACGCCGAGTGTCGCCCGCAGCCACGCGGAGGCGGCGGGGAGCCGCGCGC

GGCAGGTGCTGCAGCGCAGTAAATGTAATTTGAAGAAGGCAGAAGGAACCCATGGCTTTAGCCGGCTGCCCAGAT

TCCTTTTTGCACCATCCGTACTACCAGAGGATGATGTGGACCTGGAAGCCCTGGTGAACGATATGAATGCATCCC

TGGAGAGCCTGTACTCGGCCTGCAGCATGCAGTCAGACACGGTGCCCCTCCTGCAGAATGGCCAGCATGCCCGCA

GCCAGCCTCGGGCTTCAGGCCCTCCTCGGTCCATCCAGCCACAGGTGTCCCCGAGGCAGAGGGTGCAGCGCTCCC

AGCCTGTGCACATCCTCGCTGTCAGGCGCCTTCAGGAGGAAGACCAGCAGTTTAGAACCTCATCTCTGCCGGCCA

TCCCCAATCCTTTTCCTGAACTCTGTGGCCCTGGGAGCCCCCCTGTGCTCACGCCGGGTTCTTTACCTCCGAGCC

AGGCCGCCGCAAAGCAGGATGTTAAAGTCTTTAGTGAAGATGGGACAAGCAAAGTGGTGGAGATTCTAGCAGACA

TGACAGCCAGAGACCTGTGCCAATTGCTGGTTTACAAAAGTCACTGTGTGGATGACAACAGCTGGACACTAGTGG

AGCACCACCCGCACCTAGGATTAGAGAGGTGCTTGGAAGACCATGAGCTGGTGGTCCAGGTGGAGAGTACCATGG

CCAGTGAGAGTAAATTTCTATTCAGGAAGAATTACGCAAAATACGAGTTCTTTAAAAATCCCATGAATTTCTTCC

CAGAACAGATGGTTACTTGGTGCCAGCAGTCAAATGGCAGTCAAACCCAGCTTTTGCAGAATTTTTCTGAACTCCA

GTAGTTGTCCTGAAATTCAAGGGTTTTTGCATGTGAAAGAGCTGGGAAAGAAATCATGGAAAAAGCTGTATGTGT

GTTTGCGGAGATCTGGCCTTTATTGCTCCACCAAGGGAACTTCAAAGGAACCCAGACACCTGCAGCTGCTGGCCG

ACCTGGAGGACAGCAACATCTTCTCCCTGATCGCTGGCAGGAAGCAGTACAACGCCCCTACAGACCACGGGCTCT

GCATAAAGCCAAACAAAGTCAGGAATGAAACTAAAGAGCTGAGGTTGCTCTGTGCAGAGGACGAGCAAACCAGGA

CGTGCTGGATGACAGCGTTCAGACTCCTCAAGTATGGAATGCTCCTTTACCAGAATTACCGAATCCCTCAGCAGA

-continued

GGAAGGCCTTGCTGTCCCCGTTCTCGACGCCAGTGCGCAGTGTCTCCGAGAACTCCCTCGTGGCAATGGATTTTT

CTGGGCAAACAGGACGCGTGATAGAGAATCCGGCAGAGGCCCAGAGCGCAGCCCTGGAGGAGGGCCACGCCTGGA

GGAAGCGAAGCACACGGATGAACATCCTAGGTAGCCAAAGTCCCCTCCACCCTTCTACCCTAAGTACAGTGATTC

ACAGGACACAGCACTGGTTTCACGGGAGGATCTCCAGGGAGGAATCCCACAGGATCATTAAACAGCAAGGGCTCG

TGGATGGGCTTTTTCTCCTCCGTGACAGCCAGAGTAATCCAAAGGCATTTGTACTCACACTGTGTCATCACCAGA

AAATTAAAAATTTCCAGATCTTACCTTGCGAGGACGACGGGCAGACGTTCTTCAGCCTAGATGACGGGAACACCA

AATTCTCTGACCTGATCCAGCTGGTTGACTTTTACCAGCTGAACAAAGGAGTCCTGCCTTGCAAACTCAAGCACC

ACTGCATCCGAGTGGCCTTATGACCGCAGATGTCCTCTCGGCTGAAGACTGGAGGAAGTGAACACTGGAGTGAAG

AAGCGGTCTGTGCGTTGGTGAAGAACACACATCGATTCTGCACCTGGGGACCCAGAGCGAGATGGGTTTGTTCGG

TGCCAGCCGACCAAGATTGACTAGTTTGTTGGACTTAAACGACGATTTGCTGCTGTGAACCCAGCAGGGTCGCCT

CCCTCTGCATCGGCCAAATTGGGGAGGGCATGGAAGATCCAGCGGAAAGTTGAAAATAAACTGGAATGATCATCT

TGGCTTGGGCCGCTTAGGAACAAGAACCGGAGAGAAGTGATTGGAAATGAACTCTTGCCCTGGAATAATCTTGAC

AATTAAAACTGATATGTTTACTTTTTTTGTATTGATCACTTTTTTGCACTCCTTCTTTGTTTTCAATATTGTATT

CAGCCTATTGTAGGAGGGGGATGTGGCGTTTCAACTCATATAATACAGAAAGAGTTTTGAATGGGCAGATTTCAA

ACTGAATATGGGTCCCCAAATGTTCCCAGAGGGTCCTCCACACCCTCTGCCGACTACCACGGTGTGGATTCAGCT

CCCAAATGACAAACCCAGCCCTTCCCAGTATACTTGAAAAGCTTTCTTGTTAAAATAAAAGGTGTCACTGTGGTA

GGCATTTGGCATATTTTGTGGACTCAGTCAAGCAACCACAGTCTGTTAATCATTTCTCTATGCTCAGATGTCAGA

TCCTCTTGTTATTAGTGTGTCTTGTTCTGCACAGTGCAGGAGACTTTATTCCTTTGGAAAATTCACTGTTCCACA

AACAGCAGGCTGAATGGCCTCGCCTCTAGATTGACGTGGGCCAGCCTCCTTGAGACACACCTGGCACCCGTCATC

GGCCAGCGGTGGATGCTGCATAATCCACCTGGGTACTTCAGCCTTGCGTTTCCACAGCCTTCAGCCTGTTCTAGA

ACGATCACTGCCTTACCCCTGCTGCTGCAGTGGTGTGAGTCGTTTCACGGCTGATGTCCCTCGGGGGATTAAAGG

ATCTAAAGAGAAAATGGCACCTGGTTGTCTTCGTGCTGTGTCTCATGGGTTTCCATAGTGATAAAGACAAGGAAA

CGCTGCAGGGGCCACAGGCACAGGCTGATATTTAAAGATCTTTGCTTGCAGCCCTCCGTCCTGCTGAAAACCCCC

ATAAGCCAGTGAACACAGAGCAGCTAGAGGCTCCTCCTCTGCTGGCTTAGGGTCAGAAGTACCTCACAGTGGTTG

TGGACATGGAAGAGTTTTGTCAACACAACACTTTGTCCCCGCTCCGGGAGATGAGTCAGATGGTGGCTTGAGTTG

TCACTTGGTCCCCTCCGCCCCTCGGGTGGCCCCCTTTGCCACGTCCCCTTAGCTTAGTGATCAGGTGTGAGAGTG

GCCATTTCCTTACCTTTGATCCCTGTAAAGCAGAAAGGACTCCTTTGACAGGCGACAAACTACTGTGGTGAGCAG

AATGATTTCCTTTTTCAAGACAACACCTGCCTGGCTTCTATTAATGTGTGCTGGCCATGATATTGCCCCAAATCC

GCCCCACTGAAGTGTTCCCTAAGGAACAGCATTTCTCTGCTCCTCAGTCAACCCCCGTAGCCTAGAGCAGTGTCA

CAAGCTTCAGTAAGGCCAGTCAGCTGGAAGTCAGTCTACCGTATAGTAACACTGTATGTCAGTCTACAGACCACA

CTCTAGTTGTTTTCCATGAAAGGTATACAAATGAAGAATTTTCTAGCAAAACATGTTTTTAACCATCAGTGCTCA

ATTGCATTTTCTTCCTTTCGCAGCCAGTCAGTCTTTCAAACTATTGACAGTAAGATAATTCTCACGTTCACACCT

GGTGGCAGGCTTCACTGTAGGGACGGACATTGCAGTTACACCACGATTCCTTCCTCTTCACTGGCTCGAGGTAAA

CCCTTTTCAAGGAAAAACAACTCTAGGATTTCTTTTTTCTGTGTACGTAGACCAGTCCCATCAGTGTATAATCTC

TCTCTCACACGCCTCTCTCCAATAGACAGCTTGTATTTGCAGTATTTCATATTTATAAATATGCGTTTATTTAAA

AGGAGAACAAAAGCTTGACTCTGATTCACAGTTTTGTATGTAGCTGGTTTGACGTAGTCTTTTGTATTTTCCCTG

CCGAAGTGAATTGTTGGAGAATGTAAACCGCCTCCACGTGGCGGCAGACTTCCTAAGGCCCCAGCTCGCTGGCCT

CGCGCTGGGCGGCTGGGAATTCCACCTGAGAACAAGTCCCGCAAACCGGGGACGGAAGGACATTTGACTTTTATT

TTTGTATTTAATTGACATGAATGTAAAGGGGACAGCTCAGGGTTGTTTTGGAGCCTGTTGACTTTGTATCTCTGC

CTGTGATTTTCTTTTCTAAATGAAACTCCATGTAGCAACCAGGACGAAGTTGAGAAGGAAAACGCCAAATGCTTT

-continued

GGTTATTAGAGTTTAATAGGTAAGCTCTGTTACACTAGGTGTTAGAGTTCCAGAATGTTCTTTTGTTTGCTAAAC

CTTGAAGAAACATGTGCCTCAGCCTAGATGTTTTGTCTTCTCTTTTCTGCACTTAATACCTGACAGTATGACCGA

TCTCTGCGCCTTTCTGGGGGCGGGCAAGCTGGCGGTAGATTTGTGATGTCACAGTGCAAACTGCAGTGACTGTAA

ATTGGCCTGGCGTGTATAAACGTTTTCAGGGAATGCAGAAGGTATTAATGAAGAGACAAAACCTTTATTCCATGT

GCTTTGCTTCATTCTGTACATAGCTCTTTGGCTCGTGAACCTAATTGTAAACTTTCAGGTATTTTTGTACAAATA

AGGGACTGATGTTCTGTTTCTTGTAATTAGAAATAAACATTAATACAGTGTTCTTCA

>Reverse Complement of SEQ ID NO: 13

SEQ ID NO: 14

TGAAGAACACTGTATTAATGTTTATTTCTAATTACAAGAAACAGAACATCAGTCCCTTATTTGTACAAAAATACC

TGAAAGTTTACAATTAGGTTCACGAGCCAAAGAGCTATGTACAGAATGAAGCAAAGCACATGGAATAAAGGTTTT

GTCTCTTCATTAATACCTTCTGCATTCCCTGAAAACGTTTATACACGCCAGGCCAATTTACAGTCACTGCAGTTT

GCACTGTGACATCACAAATCTACCGCCAGCTTGCCCGCCCCCAGAAAGGCGCAGAGATCGGTCATACTGTCAGGT

ATTAAGTGCAGAAAAGAGAAGACAAAACATCTAGGCTGAGGCACATGTTTCTTCAAGGTTTAGCAAACAAAAGAA

CATTCTGGAACTCTAACACCTAGTGTAACAGAGCTTACCTATTAAACTCTAATAACCAAAGCATTTGGCGTTTTC

CTTCTCAACTTCGTCCTGGTTGCTACATGGAGTTTCATTTAGAAAAGAAAATCACAGGCAGAGATACAAAGTCAA

CAGGCTCCAAAACAACCCTGAGCTGTCCCCTTTACATTCATGTCAATTAAATACAAAAATAAAAGTCAAATGTCC

TTCCGTCCCCGGTTTGCGGGACTTGTTCTCAGGTGGAATTCCCAGCCGCCCAGCGCGAGGCCAGCGAGCTGGGGC

CTTAGGAAGTCTGCCGCCACGTGGAGGCGGTTTACATTCTCCAACAATTCACTTCGGCAGGGAAAATACAAAAGA

CTACGTCAAACCAGCTACATACAAAACTGTGAATCAGAGTCAAGCTTTTGTTCTCCTTTTAAATAAACGCATATT

TATAAATATGAAATACTGCAAATACAAGCTGTCTATTGGAGAGAGGCGTGTGAGAGAGAGATTATACACTGATGG

GACTGGTCTACGTACACAGAAAAAAGAAATCCTAGAGTTGTTTTTCCTTGAAAAGGGTTTACCTCGAGCCAGTGA

AGAGGAAGGAATCGTGGTGTAACTGCAATGTCCGTCCCTACAGTGAAGCCTGCCACCAGGTGTGAACGTGAGAAT

TATCTTACTGTCAATAGTTTGAAAGACTGACTGGCTGCGAAAGGAAGAAAATGCAATTGAGCACTGATGGTTAAA

AACATGTTTTGCTAGAAAATTCTTCATTTGTATACCTTTCATGGAAAACAACTAGAGTGTGGTCTGTAGACTGAC

ATACAGTGTTACTATACGGTAGACTGACTTCCAGCTGACTGGCCTTACTGAAGCTTGTGACACTGCTCTAGGCTA

CGGGGGTTGACTGAGGAGCAGAGAAATGCTGTTCCTTAGGGAACACTTCAGTGGGGCGGATTTGGGGCAATATCA

TGGCCAGCACACATTAATAGAAGCCAGGCAGGTGTTGTCTTGAAAAAGGAAATCATTCTGCTCACCACAGTAGTT

TGTCGCCTGTCAAAGGAGTCCTTTCTGCTTTACAGGGATCAAAGGTAAGGAAATGGCCACTCTCACACCTGATCA

CTAAGCTAAGGGGACGTGGCAAAGGGGGCCACCCGAGGGGCGGAGGGGACCAAGTGACAACTCAAGCCACCATCT

GACTCATCTCCCGGAGCGGGGACAAAGTGTTGTGTTGACAAAACTCTTCCATGTCCACAACCACTGTGAGGTACT

TCTGACCCTAAGCCAGCAGAGGAGGAGCCTCTAGCTGCTCTGTGTTCACTGGCTTATGGGGGTTTTCAGCAGGAC

GGAGGGCTGCAAGCAAAGATCTTTAAATATCAGCCTGTGCCTGTGGCCCCTGCAGCGTTTCCTTGTCTTTATCAC

TATGGAAACCCATGAGACACAGCACGAAGACAACCAGGTGCCATTTTCTCTTTAGATCCTTTAATCCCCCGAGGG

ACATCAGCCGTGAAACGACTCACACCACTGCAGCAGCAGGGGTAAGGCAGTGATCGTTCTAGAACAGGCTGAAGG

CTGTGGAAACGCAAGGCTGAAGTACCCAGGTGGATTATGCAGCATCCACCGCTGGCCGATGACGGGTGCCAGGTG

TGTCTCAAGGAGGCTGGCCCACGTCAATCTAGAGGCGAGGCCATTCAGCCTGCTGTTTGTGGAACAGTGAATTTT

CCAAAGGAATAAAGTCTCCTGCACTGTGCAGAACAAGACACACTAATAACAAGAGGATCTGACATCTGAGCATAG

AGAAATGATTAACAGACTGTGGTTGCTTGACTGAGTCCACAAAATATGCCAAATGCCTACCACAGTGACACCTTT

TATTTTAACAAGAAAGCTTTTCAAGTATACTGGGAAGGGCTGGGTTTGTCATTTGGGAGCTGAATCCACACCGTG

GTAGTCGGCAGAGGGTGTGGAGGACCCTCTGGGAACATTTGGGGACCCATATTCAGTTTGAAATCTGCCCATTCA

AAACTCTTTCTGTATTATATGAGTTGAAACGCCACATCCCCCTCCTACAATAGGCTGAATACAATATTGAAAACA

AAGAAGGAGTGCAAAAAAGTGATCAATACAAAAAAAGTAAACATATCAGTTTTAATTGTCAAGATTATTCCAGGG

-continued

CAAGAGTTCATTTCCAATCACTTCTCTCCGGTTCTTGTTCCTAAGCGGCCCAAGCCAAGATGATCATTCCAGTTT

ATTTTCAACTTTCCGCTGGATCTTCCATGCCCTCCCCAATTTGGCCGATGCAGAGGGAGGCGACCCTGCTGGGTT

CACAGCAGCAAATCGTCGTTTAAGTCCAACAAACTAGTCAATCTTGGTCGGCTGGCACCGAACAAACCCATCTCG

CTCTGGGTCCCCAGGTGCAGAATCGATGTGTGTTCTTCACCAACGCACAGACCGCTTCTTCACTCCAGTGTTCAC

TTCCTCCAGTCTTCAGCCGAGAGGACATCTGCGGTCATAAGGCCACTCGGATGCAGTGGTGCTTGAGTTTGCAAG

GCAGGACTCCTTTGTTCAGCTGGTAAAAGTCAACCAGCTGGATCAGGTCAGAGAATTTGGTGTTCCCGTCATCTA

GGCTGAAGAACGTCTGCCCGTCGTCCTCGCAAGGTAAGATCTGGAAATTTTTAATTTTCTGGTGATGACACAGTG

TGAGTACAAATGCCTTTGGATTACTCTGGCTGTCACGGAGGAGAAAAAGCCCATCCACGAGCCCTTGCTGTTTAA

TGATCCTGTGGGATTCCTCCCTGGAGATCCTCCCGTGAAACCAGTGCTGTGTCCTGTGAATCACTGTACTTAGGG

TAGAAGGGTGGAGGGGACTTTGGCTACCTAGGATGTTCATCCGTGTGCTTCGCTTCCTCCAGGCGTGGCCCTCCT

CCAGGGCTGCGCTCTGGGCCTCTGCCGGATTCTCTATCACGCGTCCTGTTTGCCCAGAAAAATCCATTGCCACGA

GGGAGTTCTCGGAGACACTGCGCACTGGCGTCGAGAACGGGGACAGCAAGGCCTTCCTCTGCTGAGGGATTCGGT

AATTCTGGTAAAGGAGCATTCCATACTTGAGGAGTCTGAACGCTGTCATCCAGCACGTCCTGGTTTGCTCGTCCT

CTGCACAGAGCAACCTCAGCTCTTTAGTTTCATTCCTGACTTTGTTTGGCTTTATGCAGAGCCCGTGGTCTGTAG

GGGCGTTGTACTGCTTCCTGCCAGCGATCAGGGAGAAGATGTTGCTGTCCTCCAGGTCGGCCAGCAGCTGCAGGT

GTCTGGGTTCCTTTGAAGTTCCCTTGGTGGAGCAATAAAGGCCAGATCTCCGCAAACACACATACAGCTTTTTCC

ATGATTTCTTTCCCAGCTCTTTCACATGCAAAAACCCTTGAATTTCAGGACAACTACTGGAGTTCAGAAAATTCT

GCAAAAGCTGGGTTTGACTGCCATTTGACTGCTGGCACCAAGTAACCATCTGTTCTGGGAAGAAATTCATGGGAT

TTTTAAAGAACTCGTATTTTGCGTAATTCTTCCTGAATAGAAATTTACTCTCACTGGCCATGGTACTCTCCACCT

GGACCACCAGCTCATGGTCTTCCAAGCACCTCTCTAATCCTAGGTGCGGGTGGTGCTCCACTAGTGTCCAGCTGT

TGTCATCCACACAGTGACTTTTGTAAACCAGCAATTGGCACAGGTCTCTGGCTGTCATGTCTGCTAGAATCTCCA

CCACTTTGCTTGTCCCATCTTCACTAAAGACTTTAACATCCTGCTTTGCGGCGGCCTGGCTCGGAGGTAAAGAAC

CCGGCGTGAGCACAGGGGGGCTCCCAGGGCCACAGAGTTCAGGAAAAGGATTGGGGATGGCCGGCAGAGATGAGG

TTCTAAACTGCTGGTCTTCCTCCTGAAGGCGCCTGACAGCGAGGATGTGCACAGGCTGGGAGCGCTGCACCCTCT

GCCTCGGGGACACCTGTGGCTGGATGGACCGAGGAGGGCCTGAAGCCCGAGGCTGGCTGCGGGCATGCTGGCCAT

TCTGCAGGAGGGGCACCGTGTCTGACTGCATGCTGCAGGCCGAGTACAGGCTCTCCAGGGATGCATTCATATCGT

TCACCAGGGCTTCCAGGTCCACATCATCCTCTGGTAGTACGGATGGTGCAAAAAGGAATCTGGGCAGCCGGCTAA

AGCCATGGGTTCCTTCTGCCTTCTTCAAATTACATTTACTGCGCTGCAGCACCTGCCGCGCGCGGCTCCCCGCCG

CCTCCGCGTGGCTGCGGGCGACACTCGGCGTGGCCGGCGGCGGGCGCGGGTCCCCGCGGGGCGAGGCCGGCGCTC

AAGACTGTCCCGGGCGCCCCGCGCCGCCGGCGCTGCCGCCACCCAGGGGCTGCGCGGAAACTTTGGGCTCCACCG

GGTCTCCGAGCGCCGAGCCCGCCCGGCCGCAGCTCGCTTCCCTCTCTGCCTCCTCCC

>NM_001371009.1 *Homo sapiens* growth factor receptor bound protein 10 (GRB10), transcript variant 8, mRNA

SEQ ID NO: 15

GGGATTCCTGTTGTGCTCCAGGACCGGGCGCTGCTCCGTCGTCCTCCCGCTCCTCAGGAGCGCCCAGTCCCTCGG

AGGCTGAGTATTGCAGCCGGGCGGCAGCCGGCTCCGCGGAGGGGCCCCCGGGCACCTGCGTGGTGATGGCGCTGG

GAGCCCCCGGGCACGCTCGGGCGGTGGCGCGGCATCCCACCCTCGCCCGGATGGCGTCCCCAGAGGCGGCGTTGG

CCCGCTTTTCGTGCTAGCGCGTTCGCCTGGCGCGCGGTGGCCCCGAGGCCCCGGGTCGGTTTTCTGCGCCGCAGG

CCCCTGGCCGGGGCGGAGCCGTGGAGGACCAGCCCGGCCCGGCTCCGAGCGCTGTCCATGCGGAGCGCTGTCCAC

GCGCCGGGCACTGCGGGGGCCGGGCCCCGAAGCCCTACCCGGGCCGGCGGCGCACACGCAGCGACCCCGTGCGGC

CAGTGCTGCCGCCCGCTCTCCAGCTTTGGCGCTGACCACAATGCTGAGCAGGAAGCAGCAGCTGCAGGCCCAGTG

ACTGGTAGCTCAGTGACCAGCAGCCCAGTGACCGGCAGCCAGGTCCTCACCTGGGTCCTCTCAGTGAAGCCAGGG

-continued

TGGCCGCCCCAGCAGACAGTGCTACAGAGCCAACTCCTGACAGAGGATGATGTGGACCTGGAAGCCCTGGTGAAC

GATATGAATGCATCCCTGGAGAGCCTGTACTCGGCCTGCAGCATGCAGTCAGACACGGTGCCCCTCCTGCAGAAT

GGCCAGCATGCCCGCAGCCAGCCTCGGGCTTCAGGCCCTCCTCGGTCCATCCAGCCACAGGTGTCCCCGAGGCAG

AGGGTGCAGCGCTCCCAGCCTGTGCACATCCTCGCTGTCAGGCGCCTTCAGGAGGAAGACCAGCAGTTTAGAACC

TCATCTCTGCCGGCCATCCCCAATCCTTTTCCTGAACTCTGTGGCCCTGGGAGCCCCCCTGTGCTCACGCCGGGT

TCTTTACCTCCGAGCCAGGCCGCCGCAAAGCAGGATGTTAAAGTCTTTAGTGAAGATGGGACAAGCAAAGTGGTG

GAGATTCTAGCAGACATGACAGCCAGAGACCTGTGCCAATTGCTGGTTTACAAAAGTCACTGTGTGGATGACAAC

AGCTGGACACTAGTGGAGCACCACCCGCACCTAGGATTAGAGAGGTGCTTGGAAGACCATGAGCTGGTGGTCCAG

GTGGAGAGTACCATGGCCAGTGAGAGTAAATTTCTATTCAGGAAGAATTACGCAAAATACGAGTTCTTTAAAAAT

CCCATGAATTTCTTCCCAGAACAGATGGTTACTTGGTGCCAGCAGTCAAATGGCAGTCAAACCCAGCTTTTGCAG

AATTTTCTGAACTCCAGTAGTTGTCCTGAAATTCAAGGGTTTTTGCATGTGAAAGAGCTGGGAAAGAAATCATGG

AAAAAGCTGTATGTGTGTTTGCGGAGATCTGGCCTTTATTGCTCCACCAAGGGAACTTCAAAGGAACCCAGACAC

CTGCAGCTGCTGGCCGACCTGGAGGACAGCAACATCTTCTCCCTGATCGCTGGCAGGAAGCAGTACAACGCCCCT

ACAGACCACGGGCTCTGCATAAAGCCAAACAAAGTCAGGAATGAAACTAAAGAGCTGAGGTTGCTCTGTGCAGAG

GACGAGCAAACCAGGACGTGCTGGATGACAGCGTTCAGACTCCTCAAGTATGGAATGCTCCTTTACCAGAATTAC

CGAATCCCTCAGCAGAGGAAGGCCTTGCTGTCCCCGTTCTCGACGCCAGTGCGCAGTGTCTCCGAGAACTCCCTC

GTGGCAATGGATTTTTCTGGGCAAACAGGACGCGTGATAGAGAATCCGGCAGAGGCCCAGAGCGCAGCCCTGGAG

GAGGGCCACGCCTGGAGGAAGCGAAGCACACGGATGAACATCCTAGGTAGCCAAAGTCCCCTCCACCCTTCTACC

CTAAGTACAGTGATTCACAGGACACAGCACTGGTTTCACGGGAGGATCTCCAGGGAGGAATCCCACAGGATCATT

AAACAGCAAGGGCTCGTGGATGGGCTTTTTCTCCTCCGTGACAGCCAGAGTAATCCAAAGGCATTTGTACTCACA

CTGTGTCATCACCAGAAAATTAAAAATTTCCAGATCTTACCTTGCGAGGACGACGGGCAGACGTTCTTCAGCCTA

GATGACGGGAACACCAAATTCTCTGACCTGATCCAGCTGGTTGACTTTTACCAGCTGAACAAAGGAGTCCTGCCT

TGCAAACTCAAGCACCACTGCATCCGAGTGGCCTTATGACCGCAGATGTCCTCTCGGCTGAAGACTGGAGGAAGT

GAACACTGGAGTGAAGAAGCGGTCTGTGCGTTGGTGAAGAACACACATCGATTCTGCACCTGGGGACCCAGAGCG

AGATGGGTTTGTTCGGTGCCAGCCGACCAAGATTGACTAGTTTGTTGGACTTAAACGACGATTTGCTGCTGTGAA

CCCAGCAGGGTCGCCTCCCTCTGCATCGGCCAAATTGGGGAGGGCATGGAAGATCCAGCGGAAAGTTGAAAATAA

ACTGGAATGATCATCTTGGCTTGGGCCGCTTAGGAACAAGAACCGGAGAGAAGTGATTGGAAATGAACTCTTGCC

CTGGAATAATCTTGACAATTAAAACTGATATGTTTACTTTTTTTGTATTGATCACTTTTTTGCACTCCTTCTTTG

TTTTCAATATTGTATTCAGCCTATTGTAGGAGGGGGATGTGGCGTTTCAACTCATATAATACAGAAAGAGTTTTG

AATGGGCAGATTTCAAACTGAATATGGGTCCCCAAATGTTCCCAGAGGGTCCTCCACACCCTCTGCCGACTACCA

CGGTGTGGATTCAGCTCCCAAATGACAAACCCAGCCCTTCCCAGTATACTTGAAAAGCTTTCTTGTTAAAATAAA

AGGTGTCACTGTGGTAGGCATTTGGCATATTTTGTGGACTCAGTCAAGCAACCACAGTCTGTTAATCATTTCTCT

ATGCTCAGATGTCAGATCCTCTTGTTATTAGTGTGTCTTGTTCTGCACAGTGCAGGAGACTTTATTCCTTTGGAA

AATTCACTGTTCCACAAACAGCAGGCTGAATGGCCTCGCCTCTAGATTGACGTGGGCCAGCCTCCTTGAGACACA

CCTGGCACCCGTCATCGGCCAGCGGTGGATGCTGCATAATCCACCTGGGTACTTCAGCCTTGCGTTTCCACAGCC

TTCAGCCTGTTCTAGAACGATCACTGCCTTACCCCTGCTGCTGCAGTGGTGTGAGTCGTTTCACGGCTGATGTCC

CTCGGGGGATTAAAGGATCTAAAGAGAAAATGGCACCTGGTTGTCTTCGTGCTGTGTCTCATGGGTTTCCATAGT

GATAAAGACAAGGAAACGCTGCAGGGGCCACAGGCACAGGCTGATATTTAAAGATCTTTGCTTGCAGCCCTCCGT

CCTGCTGAAAACCCCCATAAGCCAGTGAACACAGAGCAGCTAGAGGCTCCTCCTCTGCTGGCTTAGGGTCAGAAG

TACCTCACAGTGGTTGTGGACATGGAAGAGTTTTGTCAACACAACACTTTGTCCCCGCTCCGGGAGATGAGTCAG

-continued

ATGGTGGCTTGAGTTGTCACTTGGTCCCCTCCGCCCCTCGGGTGGCCCCCTTTGCCACGTCCCCTTAGCTTAGTG

ATCAGGTGTGAGAGTGGCCATTTCCTTACCTTTGATCCCTGTAAAGCAGAAAGGACTCCTTTGACAGGCGACAAA

CTACTGTGGTGAGCAGAATGATTTCCTTTTTCAAGACAACACCTGCCTGGCTTCTATTAATGTGTGCTGGCCATG

ATATTGCCCCAAATCCGCCCCACTGAAGTGTTCCCTAAGGAACAGCATTTCTCTGCTCCTCAGTCAACCCCCGTA

GCCTAGAGCAGTGTCACAAGCTTCAGTAAGGCCAGTCAGCTGGAAGTCAGTCTACCGTATAGTAACACTGTATGT

CAGTCTACAGACCACACTCTAGTTGTTTTCCATGAAAGGTATACAAATGAAGAATTTTCTAGCAAAACATGTTTT

TAACCATCAGTGCTCAATTGCATTTTCTTCCTTTCGCAGCCAGTCAGTCTTTCAAACTATTGACAGTAAGATAAT

TCTCACGTTCACACCTGGTGGCAGGCTTCACTGTAGGGACGGACATTGCAGTTACACCACGATTCCTTCCTCTTC

ACTGGCTCGAGGTAAACCCTTTTCAAGGAAAAACAACTCTAGGATTTCTTTTTTCTGTGTACGTAGACCAGTCCC

ATCAGTGTATAATCTCTCTCTCACACGCCTCTCTCCAATAGACAGCTTGTATTTGCAGTATTTCATATTTATAAA

TATGCGTTTATTTAAAAGGAGAACAAAAGCTTGACTCTGATTCACAGTTTTGTATGTAGCTGGTTTGACGTAGTC

TTTTGTATTTTCCCTGCCGAAGTGAATTGTTGGAGAATGTAAACCGCCTCCACGTGGCGGCAGACTTCCTAAGGC

CCCAGCTCGCTGGCCTCGCGCTGGGCGGCTGGGAATTCCACCTGAGAACAAGTCCCGCAAACCGGGGACGGAAGG

ACATTTGACTTTTATTTTTGTATTTAATTGACATGAATGTAAAGGGGACAGCTCAGGGTTGTTTTGGAGCCTGTT

GACTTTGTATCTCTGCCTGTGATTTTCTTTTCTAAATGAAACTCCATGTAGCAACCAGGACGAAGTTGAGAAGGA

AAACGCCAAATGCTTTGGTTATTAGAGTTTAATAGGTAAGCTCTGTTACACTAGGTGTTAGAGTTCCAGAATGTT

CTTTTGTTTGCTAAACCTTGAAGAAACATGTGCCTCAGCCTAGATGTTTTGTCTTCTCTTTTCTGCACTTAATAC

CTGACAGTATGACCGATCTCTGCGCCTTTCTGGGGGCGGGCAAGCTGGCGGTAGATTTGTGATGTCACAGTGCAA

ACTGCAGTGACTGTAAATTGGCCTGGCGTGTATAAACGTTTTCAGGGAATGCAGAAGGTATTAATGAAGAGACAA

AACCTTTATTCCATGTGCTTTGCTTCATTCTGTACATAGCTCTTTGGCTCGTGAACCTAATTGTAAACTTTCAGG

TATTTTTGTACAAATAAGGGACTGATGTTCTGTTTCTTGTAATTAGAAATAAACATTAATACAGTGTTCTTCA

>Reverse Complement of SEQ ID NO: 15

SEQ ID NO: 16

TGAAGAACACTGTATTAATGTTTATTTCTAATTACAAGAAACAGAACATCAGTCCCTTATTTGTACAAAAATACC

TGAAAGTTTACAATTAGGTTCACGAGCCAAAGAGCTATGTACAGAATGAAGCAAAGCACATGGAATAAAGGTTTT

GTCTCTTCATTAATACCTTCTGCATTCCCTGAAAACGTTTATACACGCCAGGCCAATTTACAGTCACTGCAGTTT

GCACTGTGACATCACAAATCTACCGCCAGCTTGCCCGCCCCCAGAAAGGCGCAGAGATCGGTCATACTGTCAGGT

ATTAAGTGCAGAAAAGAGAAGACAAAACATCTAGGCTGAGGCACATGTTTCTTCAAGGTTTAGCAAACAAAAGAA

CATTCTGGAACTCTAACACCTAGTGTAACAGAGCTTACCTATTAAACTCTAATAACCAAAGCATTTGGCGTTTTC

CTTCTCAACTTCGTCCTGGTTGCTACATGGAGTTTCATTTAGAAAAGAAAATCACAGGCAGAGATACAAAGTCAA

CAGGCTCCAAAACAACCCTGAGCTGTCCCCTTTACATTCATGTCAATTAAATACAAAAATAAAAGTCAAATGTCC

TTCCGTCCCCGGTTTGCGGGACTTGTTCTCAGGTGGAATTCCCAGCCGCCCAGCGCGAGGCCAGCGAGCTGGGGC

CTTAGGAAGTCTGCCGCCACGTGGAGGCGGTTTACATTCTCCAACAATTCACTTCGGCAGGGAAAATACAAAAGA

CTACGTCAAACCAGCTACATACAAAACTGTGAATCAGAGTCAAGCTTTTGTTCTCCTTTTAAATAAACGCATATT

TATAAATATGAAATACTGCAAATACAAGCTGTCTATTGGAGAGAGGCGTGTGAGAGAGAGATTATACACTGATGG

GACTGGTCTACGTACACAGAAAAAAGAAATCCTAGAGTTGTTTTTCCTTGAAAAGGGTTTACCTCGAGCCAGTGA

AGAGGAAGGAATCGTGGTGTAACTGCAATGTCCGTCCCTACAGTGAAGCCTGCCACCAGGTGTGAACGTGAGAAT

TATCTTACTGTCAATAGTTTGAAAGACTGACTGGCTGCGAAAGGAAGAAAATGCAATTGAGCACTGATGGTTAAA

AACATGTTTTGCTAGAAAATTCTTCATTTGTATACCTTTCATGGAAAACAACTAGAGTGTGGTCTGTAGACTGAC

ATACAGTGTTACTATACGGTAGACTGACTTCCAGCTGACTGGCCTTACTGAAGCTTGTGACACTGCTCTAGGCTA

CGGGGGTTGACTGAGGAGCAGAGAAATGCTGTTCCTTAGGGAACACTTCAGTGGGGCGGATTTGGGGCAATATCA

TGGCCAGCACACATTAATAGAAGCCAGGCAGGTGTTGTCTTGAAAAAGGAAATCATTCTGCTCACCACAGTAGTT

-continued

TGTCGCCTGTCAAAGGAGTCCTTTCTGCTTTACAGGGATCAAAGGTAAGGAAATGGCCACTCTCACACCTGATCA
CTAAGCTAAGGGGACGTGGCAAAGGGGGCCACCCGAGGGGCGGAGGGGACCAAGTGACAACTCAAGCCACCATCT
GACTCATCTCCCGGAGCGGGGACAAAGTGTTGTGTTGACAAAACTCTTCCATGTCCACAACCACTGTGAGGTACT
TCTGACCCTAAGCCAGCAGAGGAGGAGCCTCTAGCTGCTCTGTGTTCACTGGCTTATGGGGGTTTTCAGCAGGAC
GGAGGGCTGCAAGCAAAGATCTTTAAATATCAGCCTGTGCCTGTGGCCCCTGCAGCGTTTCCTTGTCTTTATCAC
TATGGAAACCCATGAGACACAGCACGAAGACAACCAGGTGCCATTTTCTCTTTAGATCCTTTAATCCCCCGAGGG
ACATCAGCCGTGAAACGACTCACACCACTGCAGCAGCAGGGGTAAGGCAGTGATCGTTCTAGAACAGGCTGAAGG
CTGTGGAAACGCAAGGCTGAAGTACCCAGGTGGATTATGCAGCATCCACCGCTGGCCGATGACGGGTGCCAGGTG
TGTCTCAAGGAGGCTGGCCCACGTCAATCTAGAGGCGAGGCCATTCAGCCTGCTGTTTGTGGAACAGTGAATTTT
CCAAAGGAATAAAGTCTCCTGCACTGTGCAGAACAAGACACACTAATAACAAGAGGATCTGACATCTGAGCATAG
AGAAATGATTAACAGACTGTGGTTGCTTGACTGAGTCCACAAAATATGCCAAATGCCTACCACAGTGACACCTTT
TATTTTAACAAGAAAGCTTTTCAAGTATACTGGGAAGGGCTGGGTTTGTCATTTGGGAGCTGAATCCACACCGTG
GTAGTCGGCAGAGGGTGTGGAGGACCCTCTGGGAACATTTGGGGACCCATATTCAGTTTGAAATCTGCCCATTCA
AAACTCTTTCTGTATTATATGAGTTGAAACGCCACATCCCCCTCCTACAATAGGCTGAATACAATATTGAAAACA
AAGAAGGAGTGCAAAAAAGTGATCAATACAAAAAAAGTAAACATATCAGTTTTAATTGTCAAGATTATTCCAGGG
CAAGAGTTCATTTCCAATCACTTCTCTCCGGTTCTTGTTCCTAAGCGGCCCAAGCCAAGATGATCATTCCAGTTT
ATTTTCAACTTTCCGCTGGATCTTCCATGCCCTCCCCAATTTGGCCGATGCAGAGGGAGGCGACCCTGCTGGGTT
CACAGCAGCAAATCGTCGTTTAAGTCCAACAAACTAGTCAATCTTGGTCGGCTGGCACCGAACAAACCCATCTCG
CTCTGGGTCCCCAGGTGCAGAATCGATGTGTGTTCTTCACCAACGCACAGACCGCTTCTTCACTCCAGTGTTCAC
TTCCTCCAGTCTTCAGCCGAGAGGACATCTGCGGTCATAAGGCCACTCGGATGCAGTGGTGCTTGAGTTTGCAAG
GCAGGACTCCTTTGTTCAGCTGGTAAAAGTCAACCAGCTGGATCAGGTCAGAGAATTTGGTGTTCCCGTCATCTA
GGCTGAAGAACGTCTGCCCGTCGTCCTCGCAAGGTAAGATCTGGAAATTTTTAATTTTCTGGTGATGACACAGTG
TGAGTACAAATGCCTTTGGATTACTCTGGCTGTCACGGAGGAGAAAAAGCCCATCCACGAGCCCTTGCTGTTTAA
TGATCCTGTGGGATTCCTCCCTGGAGATCCTCCCGTGAAACCAGTGCTGTGTCCTGTGAATCACTGTACTTAGGG
TAGAAGGGTGGAGGGGACTTTGGCTACCTAGGATGTTCATCCGTGTGCTTCGCTTCCTCCAGGCGTGGCCCTCCT
CCAGGGCTGCGCTCTGGGCCTCTGCCGGATTCTCTATCACGCGTCCTGTTTGCCCAGAAAAATCCATTGCCACGA
GGGAGTTCTCGGAGACACTGCGCACTGGCGTCGAGAACGGGGACAGCAAGGCCTTCCTCTGCTGAGGGATTCGGT
AATTCTGGTAAAGGAGCATTCCATACTTGAGGAGTCTGAACGCTGTCATCCAGCACGTCCTGGTTTGCTCGTCCT
CTGCACAGAGCAACCTCAGCTCTTTAGTTTCATTCCTGACTTTGTTTGGCTTTATGCAGAGCCCGTGGTCTGTAG
GGGCGTTGTACTGCTTCCTGCCAGCGATCAGGGAGAAGATGTTGCTGTCCTCCAGGTCGGCCAGCAGCTGCAGGT
GTCTGGGTTCCTTTGAAGTTCCCTTGGTGGAGCAATAAAGGCCAGATCTCCGCAAACACACATACAGCTTTTTCC
ATGATTTCTTTCCCAGCTCTTTCACATGCAAAAACCCTTGAATTTCAGGACAACTACTGGAGTTCAGAAAATTCT
GCAAAAGCTGGGTTTGACTGCCATTTGACTGCTGGCACCAAGTAACCATCTGTTCTGGGAAGAAATTCATGGGAT
TTTTAAAGAACTCGTATTTTGCGTAATTCTTCCTGAATAGAAATTTACTCTCACTGGCCATGGTACTCTCCACCT
GGACCACCAGCTCATGGTCTTCCAAGCACCTCTCTAATCCTAGGTGCGGGTGGTGCTCCACTAGTGTCCAGCTGT
TGTCATCCACACAGTGACTTTTGTAAACCAGCAATTGGCACAGGTCTCTGGCTGTCATGTCTGCTAGAATCTCCA
CCACTTTGCTTGTCCCATCTTCACTAAAGACTTTAACATCCTGCTTTGCGGCGGCCTGGCTCGGAGGTAAAGAAC
CCGGCGTGAGCACAGGGGGGCTCCCAGGGCCACAGAGTTCAGGAAAAGGATTGGGGATGGCCGGCAGAGATGAGG
TTCTAAACTGCTGGTCTTCCTCCTGAAGGCGCCTGACAGCGAGGATGTGCACAGGCTGGGAGCGCTGCACCCTCT
GCCTCGGGGACACCTGTGGCTGGATGGACCGAGGAGGGCCTGAAGCCCGAGGCTGGCTGCGGGCATGCTGGCCAT

-continued

TCTGCAGGAGGGGCACCGTGTCTGACTGCATGCTGCAGGCCGAGTACAGGCTCTCCAGGGATGCATTCATATCGT

TCACCAGGGCTTCCAGGTCCACATCATCCTCTGTCAGGAGTTGGCTCTGTAGCACTGTCTGCTGGGGCGGCCACC

CTGGCTTCACTGAGAGGACCCAGGTGAGGACCTGGCTGCCGGTCACTGGGCTGCTGGTCACTGAGCTACCAGTCA

CTGGGCCTGCAGCTGCTGCTTCCTGCTCAGCATTGTGGTCAGCGCCAAAGCTGGAGAGCGGGCGGCAGCACTGGC

CGCACGGGGTCGCTGCGTGTGCGCCGCCGGCCCGGGTAGGGCTTCGGGGCCCGGCCCCCGCAGTGCCCGGCGCGT

GGACAGCGCTCCGCATGGACAGCGCTCGGAGCCGGGCCGGGCTGGTCCTCCACGGCTCCGCCCCGGCCAGGGGCC

TGCGGCGCAGAAAACCGACCCGGGGCCTCGGGGCCACCGCGCGCCAGGCGAACGCGCTAGCACGAAAAGCGGGCC

AACGCCGCCTCTGGGGACGCCATCCGGGCGAGGGTGGGATGCCGCGCCACCGCCCGAGCGTGCCCGGGGGCTCCC

AGCGCCATCACCACGCAGGTGCCCGGGGGCCCCTCCGCGGAGCCGGCTGCCGCCCGGCTGCAATACTCAGCCTCC

GAGGGACTGGGCGCTCCTGAGGAGCGGGAGGACGACGGAGCAGCGCCCGGTCCTGGAGCACAACAGGAATCCC

>NM_010345.4 *Mus musculus* growth factor receptor bound protein 10 (Grb10), transcript variant 1, mRNA

SEQ ID NO: 17

ATCGAGGGGGTGGGGTGCGGGGAGGCGGCAGGAAGGGAAGGGCGCTGCGACCAGTGGCGGGCGGGATTCGCGTTC

CGAGACCCACGGGAGCACGAAGTTTCCGCGCACCGTCTCACGCACGGCGACTGGGACCGTCCAGTGTCCGGCTTT

GCCTTCGGTTTTTCTCCGTTGTGACTCGTGCAACGTGTGGCCAGCGGCCACGCGGAGGCGACGAGGAGCTGCACG

TCAGGACAAAGTGGGGCAGTCAACGTCCAAACCCGAAAACCTAGCTAAGTCTGGGTTTTCGCCACAACAAAGAAG

CCAACCAGAGCATGGTCTTGGGCTTCAAGTACTAATGAACAACGATATTAACTCGTCCGTGGAAAGCCTTAACTC

AGCTTGCAACATGCAGTCTGATACTGATACTGCACCACTTCTTGAGGATGGCCAGCATGCCAGCAACCAGGGAGC

AGCATCTAGCTCCCGGGGACAGCCACAGGCGTCCCCGAGGCAGAAAATGCAACGCTCGCAGCCTGTGCACATTCT

CAGGCGCCTTCAGGAGGAAGACCAGCAGTTAAGAACTGCATCTCTTCCGGCCATCCCCAACCCATTTCCGGAGCT

CACTGGTGCGGCCCCTGGGAGCCCTCCTTCGGTTGCTCCTAGCTCCTTACCTCCTCCTCCGAGCCAGCCACCTGC

CAAGCATTTCCCTCCAGGCTTTCAGCTGTCGAAACTCACCCGTCCAGGTCTGTGGACAAAGACCACTGCGAGATT

TTCAAAGAAACAACCTAAGAACCAGTGTCCAACCGACACTGTGAATCCAGTGGCACGGATGCCCACTTCACAGAT

GGAGAAGCTGAGGCTCAGAAAGGATGTCAAAGTCTTTAGTGAAGATGGGACCAGCAAAGTGGTGGAGATTCTAAC

CGACATGACAGCCAGGGACCTGTGCCAGCTGCTGGTTTACAAAAGTCACTGTGTGGATGACAACAGCTGGACTCT

GGTGGAACACCACCCACAACTGGGATTAGAGAGGTGCCTGGAGGACCATGAGATCGTGGTCCAAGTGGAGAGTAC

CATGCCAAGTGAGAGCAAATTCTTATTCAGAAAGAATTATGCGAAGTACGAGTTCTTTAAGAATCCAGTGAACTT

CTTCCCGGATCAGATGGTCAATTGGTGCCAGCAGTCCAACGGTGGCCAGGCGCAGCTTCTGCAGAATTTTCTGAA

CACCAGCAGCTGCCCTGAGATCCAGGGGTTCTTGCAGGTGAAAGAGGTAGGACGCAAGTCTTGGAAGAAGCTGTA

TGTGTGCCTGCGCAGATCTGGCCTCTATTACTCCACCAAGGGGACTTCAAAAGAACCCAGACACCTGCAGCTGCT

GGCTGACCTGGAAGAAAGCAGCATCTTCTACCTGATTGCTGGAAAGAAGCAGTACAACGCGCCGAATGAACATGG

GATGTGCATCAAGCCAAACAAAGCGAAGACCGAGATGAAGGAGCTTCGTCTGCTCTGTGCCGAAGATGAGCAGAT

CCGTACTTGCTGGATGACTGCCTTCAGACTGCTCAAGTACGGAATGCTCCTGTACCAAAACTATCGCATCCCACA

GAGGAAGGGTCTGCCCCCTCCTTTCAACGCACCTATGCGCAGTGTTTCTGAGAATTCTCTTGTGGCCATGGATTT

TTCTGGACAAATCGGAAGAGTGATCGATAACCCGGCTGAAGCCCAGAGTGCTGCCCTGGAAGAGGGCCATGCCTG

GCGTAAGCGGAGCACACGGATGAATATCCTAAGCAGCCAAAGCCCACTGCATCCTTCTACCCTGAATGCAGTGAT

TCACAGGACTCAGCATTGGTTCCATGGACGTATCTCCCGCGAGGAGTCTCACAGGATCATCAAGCAACAAGGTCT

CGTGGACGGGCTGTTCCTCCTTCGTGACAGCCAGAGTAATCCAAAGGCGTTCGTACTGACACTGTGCCATCACCA

GAAGATTAAAAACTTCCAGATCTTACCTTGCGAGGATGATGGGCAGACCTTCTTCACTCTGGATGATGGGAACAC

CAAGTTCTCCGATCTGATCCAGCTGGTCGACTTCTACCAGCTCAACAAAGGTGTTCTGCCCTGCAAGCTGAAACA

CCACTGCATCCGCGTGGCCTTATGACCTCCTTGCCCACTCACAGAGGCTGGAGGCAGCGACACTGGAACGGAGAA

-continued

GAGAGATCTGCATGAGGGTGAGAACACACACCTACTCCCACCCAAGGACTCAGAACAACATGGCTTTTTGATCGG

TACCAACCGACCTACATCAATTAGTTATTGGACTTCACAAAGATTTGCCGCTGTGGATCAAACAGGACCACCTCC

CTCTGCGTCAGCCATTTAAAATTGGGGGAGGGAAGAGATCCAGTGCAAGTGTGGGAAGAAACTGGAATGACGATT

TTGATTAGGCCACGTAGGGTGAAAACCGCAGAAAAATGATTGGAAATGAACTCTTGCCCTGGAATAACCTTGACA

ATTCAAACCGCGATGTTTACTTTTTGTATTGATCACTTTTTTGCACTCCTTCTTCGTTGTCGATGTTGTACTCAG

CCTATGGTAGGAGAGGATGTGGCTTTGCAACTCAGATCAGACAAAGAATTTTTGAATTGGCAGGCTTTAGCCTAC

AAATGGGTCCCCCAAGTTTTCTAGATAACATCCTGCTCTCTGCAGGTTGCGGCAGTGTGGGTTTGGCTCCAGTCC

TTCCCATTATACTTGAAAAGCTTTTTTTTTTTTTTTAAATAAAATAATAAGATAAAAGGTGACAACCGCAGTTGA

CACCTAGCATGTTTTGTGGACGCAGTCAAGCTGCCACAGTCTGGTCATCGTTGTTGTTGTGCTGACGTCTGGTCA

TGTATTATTAGTGTGTCTCGTTCTCCACGGTGCTGGAGACCTCATTACTTTGGAAAACTCACTGTTCCCCAGCAC

AGCACAGCTGCATGACCTCAGCTTCAGACTGATGTCAGCCAGCCTTCTTGGAACACATTGCTATTCATTGTGGAT

GCCACACAGTCCATCTGGGGTGCCCTGTGCCTCCCATTTTCACAGCCGCCCACTGTTGTAGAATAATCGCTGCCT

TTACCCTCTGCAGTACCCTCAGTCATTTCACTTCTCCCACAGGGGTGGGGTAGGGGTGGGGTTAAAGGATCGAAA

GAGAAAAAAACGCCAACTTGTTGGCCTTGTGCTCTGTCACTCTGAGCATCTATGGTGATAAAGAGAAGGAAACGC

TGCAGAGGCACAAGCATAAGCTGGCTTTGAGTCTTTGAAAGCTTGATGGCCTCTGCACCCTACTGAAAACCCCCT

AAGCCAGCAGGAGCAGGGTATGCAGAGGCTTTGCCTCTGCTGGCTTAGGGTGAGAAGTACCTCACAATGGATGTG

AACATTGGACAGATTTTAGGAGCATGATGTTTGCCTCCTCCGAGAGAGAGGAGTCAGAGAGAGAGAGGAGTCAGA

AGGTGGCCGGAGTTATCATTGGGTCCCCTGAGCTCCATGAAGGACCCTCTGTTGTCCCCTTGATGATTTATCAGG

CATGAGAGTAGCAGACAGGATTGCCTTGAGAAACACACAGACAACAACGGTGGTGAACACATTTCCCTTTCTTGA

TACCACCCAGAAAGTCTGCTACATACCTGAGTTAGCCACTAGATTGCCTGTCCCGACTCATTGAAGTGCTCCCCA

GGGAGCCACTTCTGATTTGCCATGGTTGACAGCATAGTGGAAGATAGATATGACAGCGCTTTGTAAAGCAGGCCA

GTGGCAAGCTGGCCCACAGTAGAGAAACACTGTAGTTCACAGACCATGCAACCGTGTTTCCACGAGATGTTATTA

CAACAAATGAAGAATTTTTTTCCTTTTTTTTCATTTTAATCTTTTTTGACTTTTTTTAGTTAACCATTTTTTAT

GCATAAGTGCTCAAATGCATTTCTCTTTCTTTCGAAACTAGTTAATCGTTAAGTTGACAATGAGAGAATTCTCAA

GTTCATACCTGGCAGCAGGCTCCCACTGATCTTCCCCTTACAGACAGATAACAGACATTTCAGTTTTACCGTGCT

CATTTCTTTTTGCTGACTTAAGGTCAGAACTTTTACAGACAACAAACAACCCTAGGGTTTCTTTTTCCAGTTTAC

ACAGACCGGTCCCCACAGTGCAGAATCCATTTCTCTTTCGTCTCAACAGTAGACAACTAGGATGTGGATCTCATA

TTTATAAGTATGCATTTTATTTAAGAGGAAGTATAGGCTTGACTCTGGTTCACAATTTCGTACGTAGCTGGTTTG

ACGTAGAACTTTGTACTTCCCTTGCCGAAGTGAATTGTTGAAGGCTGCAACCCCACCCACCTTGAGTGTAGCAGAC

TTCAGTGGCCCCGAGATCGCCAGCCCTTTGCACAGGCAGCTGGGAATTCCACCTGAAACAGCTGGTCCCTAGGTT

AGCGGGTTCCCAGCCCCCCTAATCAGAGACTGAAGGACAATTGACTTTTATTTTTGTATTTAATTGACATGAATG

TAAAGGGGACAGCTCAGGGTTGTTTTGGAGCCTGTTTGACTTTGTAATCTCTGCCTGTGATTTTCTTTTCTAAAT

GACGACTCCGTGTAACCACCTGGACTAAGTTGAGAAGGAAACTGCCAAATGCTTTGGGTTTTTAGGGTTTTAATA

GGTAGACTCTGTTCTATTATTAGGTGTTAAGAGTTTCCAAACGTGTTTTCTTTTTTCTTTTATTGTTTGCTTAAA

CTTTGAAGAAATATGTGCCTCAGCTTAGATGTTTTGTCTTCCCCTTTCTGCACTTAAATACCTGACAGCCTGTTC

GATCGCTGTGCCTCCGAGGGCGCTTCTAGCTCATCGTAGATTTGTGATGTCATAGTGCAAACTGCAGTGACCGGT

AAAATGACCTGACATGTAACCGTTTTCAGGGAATGCAGAGGGTGTTAACTAATAGACAAAACCTTTATCCCGCGT

-continued

GCTTTGCTTCACCTTGTGCTATATAGCTCTTTGGCTCGTGAACCTAATTGTAAACTTTCAGGTATTTTTGTACAA

ATAAGGGACTGATGTTCTGTTTCTTGTTATTAGAAATAAACATTAATAAAGCGTTCTTGGTGTC

>Reverse Complement of SEQ ID NO: 17

SEQ ID NO: 18

GACACCAAGAACGCTTTATTAATGTTTATTTCTAATAACAAGAAACAGAACATCAGTCCCTTATTTGTACAAAAA

TACCTGAAAGTTTACAATTAGGTTCACGAGCCAAAGAGCTATATAGCACAAGGTGAAGCAAAGCACGCGGATAA

AGGTTTTGTCTATTAGTTAACACCCTCTGCATTCCCTGAAAACGGTTACATGTCAGGTCATTTTACCGGTCACTG

CAGTTTGCACTATGACATCACAAATCTACGATGAGCTAGAAGCGCCCTCGGAGGCACAGCGATCGAACAGGCTGT

CAGGTATTTAAGTGCAGAAAGGGGAAGACAAAACATCTAAGCTGAGGCACATATTTCTTCAAAGTTTAAGCAAAC

AATAAAAGAAAAAAGAAAACACGTTTGGAAACTCTTAACACCTAATAATAGAACAGAGTCTACCTATTAAAACCC

TAAAAACCCAAAGCATTTGGCAGTTTCCTTCTCAACTTAGTCCAGGTGGTTACACGGAGTCGTCATTTAGAAAAG

AAAATCACAGGCAGAGATTACAAAGTCAAACAGGCTCCAAAACAACCCTGAGCTGTCCCCTTTACATTCATGTCA

ATTAAATACAAAAATAAAAGTCAATTGTCCTTCAGTCTCTGATTAGGGGGGCTGGGAACCCGCTAACCTAGGGAC

CAGCTGTTTCAGGTGGAATTCCCAGCTGCCTGTGCAAAGGGCTGGCGATCTCGGGGCCACTGAAGTCTGCTACAC

TCAAGGTGGGTGGGTTGCAGCCTTCAACAATTCACTTCGGCAAGGGAAGTACAAAGTTCTACGTCAAACCAGCTA

CGTACGAAATTGTGAACCAGAGTCAAGCCTATACTTCCTCTTAAATAAAATGCATACTTATAAATATGAGATCCA

CATCCTAGTTGTCTACTGTTGAGACGAAAGAGAAATGGATTCTGCACTGTGGGGACCGGTCTGTGTAAACTGGAA

AAAGAAACCCTAGGGTTGTTTGTTGTCTGTAAAAGTTCTGACCTTAAGTCAGCAAAAAGAAATGAGCACGGTAAA

ACTGAAATGTCTGTTATCTGTCTGTAAGGGGAAGATCAGTGGGAGCCTGCTGCCAGGTATGAACTTGAGAATTCT

CTCATTGTCAACTTAACGATTAACTAGTTTCGAAAGAAAGAGAAATGCATTTGAGCACTTATGCATAAAAAAATGG

TTAACTAAAAAAAAGTCAAAAAAGATTAAAATGAAAAAAAAGGAAAAAAATTCTTCATTTGTTGTAATAACATCT

CGTGGAAACACGGTTGCATGGTCTGTGAACTACAGTGTTTCTCTACTGTGGGCCAGCTTGCCACTGGCCTGCTTT

ACAAAGCGCTGTCATATCTATCTTCCACTATGCTGTCAACCATGGCAAATCAGAAGTGGCTCCCTGGGGAGCACT

TCAATGAGTCGGGACAGGCAATCTAGTGGCTAACTCAGGTATGTAGCAGACTTTCTGGGTGGTATCAAGAAAGGG

AAATGTGTTCACCACCGTTGTTGTCTGTGTGTTTCTCAAGGCAATCCTGTCTGCTACTCTCATGCCTGATAAATC

ATCAAGGGGACAACAGAGGGTCCTTCATGGAGCTCAGGGGACCCAATGATAACTCCGGCCACCTTCTGACTCCTC

TCTCTCTCTGACTCCTCTCTCTCGGAGGAGGCAAACATCATGCTCCTAAAATCTGTCCAATGTTCACATCCATTG

TGAGGTACTTCTCACCCTAAGCCAGCAGAGGCAAAGCCTCTGCATACCCTGCTCCTGCTGGCTTAGGGGGTTTTC

AGTAGGGTGCAGAGGCCATCAAGCTTTCAAAGACTCAAAGCCAGCTTATGCTTGTGCCTCTGCAGCGTTTCCTTC

TCTTTATCACCATAGATGCTCAGAGTGACAGAGCACAAGGCCAACAAGTTGGCGTTTTTTTCTCTTTCGATCCTT

TAACCCCACCCCTACCCCACCCCTGTGGGAGAAGTGAAATGACTGAGGGTACTGCAGAGGGTAAAGGCAGCGATT

ATTCTACAACAGTGGGCGGCTGTGAAAATGGGAGGCACAGGGCACCCCAGATGGACTGTGTGGCATCCACAATGA

ATAGCAATGTGTTCCAAGAAGGCTGGCTGACATCAGTCTGAAGCTGAGGTCATGCAGCTGTGCTGTGCTGGGGAA

CAGTGAGTTTTCCAAAGTAATGAGGTCTCCAGCACCGTGGAGAACGAGACACACTAATAATACATGACCAGACGT

CAGCACAACAACAACGATGACCAGACTGTGGCAGCTTGACTGCGTCCACAAAACATGCTAGGIGTCAACTGCGGT

TGTCACCTTTTATCTTATTATTTTATTTAAAAAAAAAAAAAAAGCTTTTCAAGTATAATGGGAAGGACTGGAGCC

AAACCCACACTGCCGCAACCTGCAGAGAGCAGGATGTTATCTAGAAAACTTGGGGGACCCATTTGTAGGCTAAAG

CCTGCCAATTCAAAAATTCTTTGTCTGATCTGAGTTGCAAAGCCACATCCTCTCCTACCATAGGCTGAGTACAAC

ATCGACAACGAAGAAGGAGTGCAAAAAAGTGATCAATACAAAAAGTAAACATCGCGGTTTGAATTGTCAAGGTTA

TTCCAGGGCAAGAGTTCATTTCCAATCATTTTTCTGCGGTTTTCACCCTACGTGGCCTAATCAAAATCGTCATTC

CAGTTTCTTCCCACACTTGCACTGGATCTCTTCCCTCCCCCAATTTTAAATGGCTGACGCAGAGGGAGGTGGTCC

TGTTTGATCCACAGCGGCAAATCTTTGTGAAGTCCAATAACTAATTGATGTAGGTCGGTTGGTACCGATCAAAAA

-continued

GCCATGTTGTTCTGAGTCCTTGGGTGGGAGTAGGTGTGTGTTCTCACCCTCATGCAGATCTCTCTTCTCCGTTCC

AGTGTCGCTGCCTCCAGCCTCTGTGAGTGGGCAAGGAGGTCATAAGGCCACGCGGATGCAGTGGTGTTTCAGCTT

GCAGGGCAGAACACCTTTGTTGAGCTGGTAGAAGTCGACCAGCTGGATCAGATCGGAGAACTTGGTGTTCCCATC

ATCCAGAGTGAAGAAGGTCTGCCCATCATCCTCGCAAGGTAAGATCTGGAAGTTTTTAATCTTCTGGTGATGGCA

CAGTGTCAGTACGAACGCCTTTGGATTACTCTGGCTGTCACGAAGGAGGAACAGCCCGTCCACGAGACCTTGTTG

CTTGATGATCCTGTGAGACTCCTCGCGGGAGATACGTCCATGGAACCAATGCTGAGTCCTGTGAATCACTGCATT

CAGGGTAGAAGGATGCAGTGGGCTTTGGCTGCTTAGGATATTCATCCGTGTGCTCCGCTTACGCCAGGCATGGCC

CTCTTCCAGGGCAGCACTCTGGGCTTCAGCCGGGTTATCGATCACTCTTCCGATTTGTCCAGAAAAATCCATGGC

CACAAGAGAATTCTCAGAAACACTGCGCATAGGTGCGTTGAAAGGAGGGGGCAGACCCTTCCTCTGTGGGATGCG

ATAGTTTTGGTACAGGAGCATTCCGTACTTGAGCAGTCTGAAGGCAGTCATCCAGCAAGTACGGATCTGCTCATC

TTCGGCACAGAGCAGACGAAGCTCCTTCATCTCGGTCTTCGCTTTGTTTGGCTTGATGCACATCCCATGTTCATT

CGGCGCGTTGTACTGCTTCTTTCCAGCAATCAGGTAGAAGATGCTGCTTTCTTCCAGGTCAGCCAGCAGCTGCAG

GTGTCTGGGTTCTTTTGAAGTCCCCTTGGTGGAGTAATAGAGGCCAGATCTGCGCAGGCACACATACAGCTTCTT

CCAAGACTTGCGTCCTACCTCTTTCACCTGCAAGAACCCCTGGATCTCAGGGCAGCTGCTGGTGTTCAGAAAATT

CTGCAGAAGCTGCGCCTGGCCACCGTTGGACTGCTGGCACCAATTGACCATCTGATCCGGGAAGAAGTTCACTGG

ATTCTTAAAGAACTCGTACTTCGCATAATTCTTTCTGAATAAGAATTTGCTCTCACTTGGCATGGTACTCTCCAC

TTGGACCACGATCTCATGGTCCTCCAGGCACCTCTCTAATCCCAGTTGTGGGTGGTGTTCCACCAGAGTCCAGCT

GTTGTCATCCACACAGTGACTTTTGTAAACCAGCAGCTGGCACAGGTCCCTGGCTGTCATGTCGGTTAGAATCTC

CACCACTTTGCTGGTCCCATCTTCACTAAAGACTTTGACATCCTTTCTGAGCCTCAGCTTCTCCATCTGTGAAGT

GGGCATCCGTGCCACTGGATTCACAGTGTCGGTTGGACACTGGTTCTTAGGTTGTTTCTTTGAAAATCTCGCAGT

GGTCTTTGTCCACAGACCTGGACGGGTGAGTTTCGACAGCTGAAAGCCTGGAGGGAAATGCTTGGCAGGTGGCTG

GCTCGGAGGAGGAGGTAAGGAGCTAGGAGCAACCGAAGGAGGGCTCCCAGGGGCCGCACCAGTGAGCTCCGGAAA

TGGGTTGGGGATGGCCGGAAGAGATGCAGTTCTTAACTGCTGGTCTTCCTCCTGAAGGCGCCTGAGAATGTGCAC

AGGCTGCGAGCGTTGCATTTTCTGCCTCGGGGACGCCTGTGGCTGTCCCCGGGAGCTAGATGCTGCTCCCTGGTT

GCTGGCATGCTGGCCATCCTCAAGAAGTGGTGCAGTATCAGTATCAGACTGCATGTTGCAAGCTGAGTTAAGGCT

TTCCACGGACGAGTTAATATCGTTGTTCATTAGTACTTGAAGCCCAAGACCATGCTCTGGTTGGCTTCTTTGTTG

TGGCGAAAACCCAGACTTAGCTAGGTTTTCGGGTTTGGACGTTGACTGCCCCACTTTGTCCTGACGTGCAGCTCC

TCGTCGCCTCCGCGTGGCCGCTGGCCACACGTTGCACGAGTCACAACGGAGAAAAACCGAAGGCAAAGCCGGACA

CTGGACGGTCCCAGTCGCCGTGCGTGAGACGGTGCGCGGAAACTTCGTGCTCCCGTGGGTCTCGGAACGCGAATC

CCGCCCGCCACTGGTCGCAGCGCCCTTCCCTTCCTGCCGCCTCCCCGCACCCCACCCCCTCGAT

>NM_001177629.1 *Mus musculus* growth factor receptor bound protein 10 (Grb10), transcript variant 2, mRNA

SEQ ID NO: 19

ATCGCCATCTACAGTTTCTGTCTGTTAGAGGAGAGTGTGAAATCTACTGCGTCCTAGCTCTGTACCTTGGACAAA

GTGGGGCAGTCAACGTCCAAACCCGAAAACCTAGCTAAGTCTGGGTTTTCGCCACAACAAAGAAGCCAACCAGAG

CATGGTCTTGGGCTTCAAGTACTAATGAACAACGATATTAACTCGTCCGTGGAAAGCCTTAACTCAGCTTGCAAC

ATGCAGTCTGATACTGATACTGCACCACTTCTTGAGGATGGCCAGCATGCCAGCAACCAGGGAGCAGCATCTAGC

TCCCGGGGACAGCCACAGGCGTCCCCGAGGCAGAAAATGCAACGCTCGCAGCCTGTGCACATTCTCAGGCGCCTT

CAGGAGGAAGACCAGCAGTTAAGAACTGCATCTCTTCCGGCCATCCCCAACCCATTTCCGGAGCTCACTGGTGCG

GCCCCTGGGAGCCCTCCTTCGGTTGCTCCTAGCTCCTTACCTCCTCCTCCGAGCCAGCCACCTGCCAAGCATGAT

GTCAAAGTCTTTAGTGAAGATGGGACCAGCAAAGTGGTGGAGATTCTAACCGACATGACAGCCAGGGACCTGTGC

CAGCTGCTGGTTTACAAAAGTCACTGTGTGGATGACAACAGCTGGACTCTGGTGGAACACCACCCACAACTGGGA

-continued

TTAGAGAGGTGCCTGGAGGACCATGAGATCGTGGTCCAAGTGGAGAGTACCATGCCAAGTGAGAGCAAATTCTTA

TTCAGAAAGAATTATGCGAAGTACGAGTTCTTTAAGAATCCAGTGAACTTCTTCCCGGATCAGATGGTCAATTGG

TGCCAGCAGTCCAACGGTGGCCAGGCGCAGCTTCTGCAGAATTTTCTGAACACCAGCAGCTGCCCTGAGATCCAG

GGGTTCTTGCAGGTGAAAGAGGTAGGACGCAAGTCTTGGAAGAAGCTGTATGTGTGCCTGCGCAGATCTGGCCTC

TATTACTCCACCAAGGGGACTTCAAAAGAACCCAGACACCTGCAGCTGCTGGCTGACCTGGAAGAAAGCAGCATC

TTCTACCTGATTGCTGGAAAGAAGCAGTACAACGCGCCGAATGAACATGGGATGTGCATCAAGCCAAACAAAGCG

AAGACCGAGATGAAGGAGCTTCGTCTGCTCTGTGCCGAAGATGAGCAGATCCGTACTTGCTGGATGACTGCCTTC

AGACTGCTCAAGTACGGAATGCTCCTGTACCAAAACTATCGCATCCCACAGAGGAAGGGTCTGCCCCCTCCTTTC

AACGCACCTATGCGCAGTGTTTCTGAGAATTCTCTTGTGGCCATGGATTTTTCTGGACAAATCGGAAGAGTGATC

GATAACCCGGCTGAAGCCCAGAGTGCTGCCCTGGAAGAGGGCCATGCCTGGCGTAAGCGGAGCACACGGATGAAT

ATCCTAAGCAGCCAAAGCCCACTGCATCCTTCTACCCTGAATGCAGTGATTCACAGGACTCAGCATTGGTTCCAT

GGACGTATCTCCCGCGAGGAGTCTCACAGGATCATCAAGCAACAAGGTCTCGTGGACGGGCTGTTCCTCCTTCGT

GACAGCCAGAGTAATCCAAAGGCGTTCGTACTGACACTGTGCCATCACCAGAAGATTAAAAACTTCCAGATCTTA

CCTTGCGAGGATGATGGGCAGACCTTCTTCACTCTGGATGATGGGAACACCAAGTTCTCCGATCTGATCCAGCTG

GTCGACTTCTACCAGCTCAACAAAGGTGTTCTGCCCTGCAAGCTGAAACACCACTGCATCCGCGTGGCCTTATGA

CCTCCTTGCCCACTCACAGAGGCTGGAGGCAGCGACACTGGAACGGAGAAGAGAGATCTGCATGAGGGTGAGAAC

ACACACCTACTCCCACCCAAGGACTCAGAACAACATGGCTTTTTGATCGGTACCAACCGACCTACATCAATTAGT

TATTGGACTTCACAAAGATTTGCCGCTGTGGATCAAACAGGACCACCTCCCTCTGCGTCAGCCATTTAAAATTGG

GGGAGGGAAGAGATCCAGTGCAAGTGTGGGAAGAAACTGGAATGACGATTTTGATTAGGCCACGTAGGGTGAAAA

CCGCAGAAAAAATGATTGGAAATGAACTCTTGCCCTGGAATAACCTTGACAATTCAAACCGCGATGTTTACTTTTT

GTATTGATCACTTTTTTGCACTCCTTCTTCGTTGTCGATGTTGTACTCAGCCTATGGTAGGAGAGGATGTGGCTT

TGCAACTCAGATCAGACAAAGAATTTTTGAATTGGCAGGCTTTAGCCTACAAATGGGTCCCCCAAGTTTTCTAGA

TAACATCCTGCTCTCTGCAGGTTGCGGCAGTGTGGGTTTGGCTCCAGTCCTTCCCATTATACTTGAAAAGCTTTT

TTTTTTTTTTAAATAAAATAATAAGATAAAAGGTGACAACCGCAGTTGACACCTAGCATGTTTTGTGGACGCAG

TCAAGCTGCCACAGTCTGGTCATCGTTGTTGTTGTGCTGACGTCTGGTCATGTATTATTAGTGTGTCTCGTTCTC

CACGGTGCTGGAGACCTCATTACTTTGGAAAACTCACTGTTCCCCAGCACAGCACAGCTGCATGACCTCAGCTTC

AGACTGATGTCAGCCAGCCTTCTTGGAACACATTGCTATTCATTGTGGATGCCACACAGTCCATCTGGGGTGCCC

TGTGCCTCCCATTTTCACAGCCGCCCACTGTTGTAGAATAATCGCTGCCTTTACCCTCTGCAGTACCCTCAGTCA

TTTCACTTCTCCCACAGGGGTGGGGTAGGGGTGGGGTTAAAGGATCGAAAGAGAAAAAAACGCCAACTTGTTGGC

CTTGTGCTCTGTCACTCTGAGCATCTATGGTGATAAAGAGAAGGAAACGCTGCAGAGGCACAAGCATAAGCTGGC

TTTGAGTCTTTGAAAGCTTGATGGCCTCTGCACCCTACTGAAAACCCCCTAAGCCAGCAGGAGCAGGGTATGCAG

AGGCTTTGCCTCTGCTGGCTTAGGGTGAGAAGTACCTCACAATGGATGTGAACATTGGACAGATTTTAGGAGCAT

GATGTTTGCCTCCTCCGAGAGAGAGGAGTCAGAGAGAGAGAGGAGTCAGAAGGTGGCCGGAGTTATCATTGGGTC

CCCTGAGCTCCATGAAGGACCCTCTGTTGTCCCCTTGATGATTTATCAGGCATGAGAGTAGCAGACAGGATTGCC

TTGAGAAACACACAGACAACAACGGTGGTGAACACATTTCCCTTTCTTGATACCACCCAGAAAGTCTGCTACATA

CCTGAGTTAGCCACTAGATTGCCTGTCCCGACTCATTGAAGTGCTCCCCAGGGAGCCACTTCTGATTTGCCATGG

TTGACAGCATAGTGGAAGATAGATATGACAGCGCTTTGTAAAGCAGGCCAGTGGCAAGCTGGCCCACAGTAGAGA

AACACTGTAGTTCACAGACCATGCAACCGTGTTTCCACGAGATGTTATTACAACAAATGAAGAATTTTTTTCCTT

TTTTTTCATTTTAATCTTTTTTGACTTTTTTTTAGTTAACCATTTTTTATGCATAAGTGCTCAAATGCATTTCTC

TTTCTTTCGAAACTAGTTAATCGTTAAGTTGACAATGAGAGAATTCTCAAGTTCATACCTGGCAGCAGGCTCCCA

-continued

CTGATCTTCCCCTTACAGACAGATAACAGACATTTCAGTTTTACCGTGCTCATTTCTTTTTGCTGACTTAAGGTC

AGAACTTTTACAGACAACAAACAACCCTAGGGTTTCTTTTTCCAGTTTACACAGACCGGTCCCCACAGTGCAGAA

TCCATTTCTCTTTCGTCTCAACAGTAGACAACTAGGATGTGGATCTCATATTTATAAGTATGCATTTTATTTAAG

AGGAAGTATAGGCTTGACTCTGGTTCACAATTTCGTACGTAGCTGGTTTGACGTAGAACTTTGTACTTCCCTTGC

CGAAGTGAATTGTTGAAGGCTGCAACCCACCCACCTTGAGTGTAGCAGACTTCAGTGGCCCCGAGATCGCCAGCC

CTTTGCACAGGCAGCTGGGAATTCCACCTGAAACAGCTGGTCCCTAGGTTAGCGGGTTCCCAGCCCCCCTAATCA

GAGACTGAAGGACAATTGACTTTTATTTTTGTATTTAATTGACATGAATGTAAAGGGGACAGCTCAGGGTTGTTT

TGGAGCCTGTTTGACTTTGTAATCTCTGCCTGTGATTTTCTTTTCTAAATGACGACTCCGTGTAACCACCTGGAC

TAAGTTGAGAAGGAAACTGCCAAATGCTTTGGGTTTTTAGGGTTTTAATAGGTAGACTCTGTTCTATTATTAGGT

GTTAAGAGTTTCCAAACGTGTTTTCTTTTTTCTTTTATTGTTTGCTTAAACTTTGAAGAAATATGTGCCTCAGCT

TAGATGTTTTGTCTTCCCCTTTCTGCACTTAAATACCTGACAGCCTGTTCGATCGCTGTGCCTCCGAGGGCGCTT

CTAGCTCATCGTAGATTTGTGATGTCATAGTGCAAACTGCAGTGACCGGTAAAATGACCTGACATGTAACCGTTT

TCAGGGAATGCAGAGGGTGTTAACTAATAGACAAAACCTTTATCCCGCGTGCTTTGCTTCACCTTGTGCTATATA

GCTCTTTGGCTCGTGAACCTAATTGTAAACTTTCAGGTATTTTTGTACAAATAAGGGACTGATGTTCTGTTTCTT

GTTATTAGAAATAAACATTAATAAAGCGTTCTTGGTGTC

>Reverse Complement of SEQ ID NO: 19

SEQ ID NO: 20

GACACCAAGAACGCTTTATTAATGTTTATTTCTAATAACAAGAAACAGAACATCAGTCCCTTATTTGTACAAAAA

TACCTGAAAGTTTACAATTAGGTTCACGAGCCAAAGAGCTATATAGCACAAGGTGAAGCAAAGCACGCGGGATAA

AGGTTTTGTCTATTAGTTAACACCCTCTGCATTCCCTGAAAACGGTTACATGTCAGGTCATTTTACCGGTCACTG

CAGTTTGCACTATGACATCACAAATCTACGATGAGCTAGAAGCGCCCTCGGAGGCACAGCGATCGAACAGGCTGT

CAGGTATTTAAGTGCAGAAAGGGGAAGACAAAACATCTAAGCTGAGGCACATATTTCTTCAAAGTTTAAGCAAAC

AATAAAAGAAAAAAGAAAACACGTTTGGAAACTCTTAACACCTAATAATAGAACAGAGTCTACCTATTAAAACCC

TAAAAACCCAAAGCATTTGGCAGTTTCCTTCTCAACTTAGTCCAGGTGGTTACACGGAGTCGTCATTTAGAAAAG

AAAATCACAGGCAGAGATTACAAAGTCAAACAGGCTCCAAAACAACCCTGAGCTGTCCCCTTTACATTCATGTCA

ATTAAATACAAAAATAAAAGTCAATTGTCCTTCAGTCTCTGATTAGGGGGGCTGGGAACCCGCTAACCTAGGGAC

CAGCTGTTTCAGGTGGAATTCCCAGCTGCCTGTGCAAAGGGCTGGCGATCTCGGGGCCACTGAAGTCTGCTACAC

TCAAGGTGGGTGGGTTGCAGCCTTCAACAATTCACTTCGGCAAGGGAAGTACAAAGTTCTACGTCAAACCAGCTA

CGTACGAAATTGTGAACCAGAGTCAAGCCTATACTTCCTCTTAAATAAAATGCATACTTATAAATATGAGATCCA

CATCCTAGTTGTCTACTGTTGAGACGAAAGAGAAATGGATTCTGCACTGTGGGGACCGGTCTGTGTAAACTGGAA

AAAGAAACCCTAGGGTTGTTTGTTGTCTGTAAAAGTTCTGACCTTAAGTCAGCAAAAAGAAATGAGCACGGTAAA

ACTGAAATGTCTGTTATCTGTCTGTAAGGGGAAGATCAGTGGGAGCCTGCTGCCAGGTATGAACTTGAGAATTCT

CTCATTGTCAACTTAACGATTAACTAGTTTCGAAAGAAAGAGAAATGCATTTGAGCACTTATGCATAAAAAATGG

TTAACTAAAAAAAAGTCAAAAAGATTAAAATGAAAAAAAAGGAAAAAAATTCTTCATTTGTTGTAATAACATCT

CGTGGAAACACGGTTGCATGGTCTGTGAACTACAGTGTTTCTCTACTGTGGGCCAGCTTGCCACTGGCCTGCTTT

ACAAAGCGCTGTCATATCTATCTTCCACTATGCTGTCAACCATGGCAAATCAGAAGTGGCTCCCTGGGGAGCACT

TCAATGAGTCGGGACAGGCAATCTAGTGGCTAACTCAGGTATGTAGCAGACTTTCTGGGTGGTATCAAGAAAGGG

AAATGTGTTCACCACCGTTGTTGTCTGTGTGTTTCTCAAGGCAATCCTGTCTGCTACTCTCATGCCTGATAAATC

ATCAAGGGGACAACAGAGGGTCCTTCATGGAGCTCAGGGGACCCAATGATAACTCCGGCCACCTTCTGACTCCTC

TCTCTCTCTGACTCCTCTCTCTCGGAGGAGGCAAACATCATGCTCCTAAAATCTGTCCAATGTTCACATCCATTG

TGAGGTACTTCTCACCCTAAGCCAGCAGAGGCAAAGCCTCTGCATACCCTGCTCCTGCTGGCTTAGGGGGTTTTC

AGTAGGGTGCAGAGGCCATCAAGCTTTCAAAGACTCAAAGCCAGCTTATGCTTGTGCCTCTGCAGCGTTTCCTTC

-continued

TCTTTATCACCATAGATGCTCAGAGTGACAGAGCACAAGGCCAACAAGTTGGCGTTTTTTTCTCTTTCGATCCTT

TAACCCCACCCCTACCCCACCCCTGTGGGAGAAGTGAAATGACTGAGGGTACTGCAGAGGGTAAAGGCAGCGATT

ATTCTACAACAGTGGGCGGCTGTGAAAATGGGAGGCACAGGGCACCCCAGATGGACTGTGTGGCATCCACAATGA

ATAGCAATGTGTTCCAAGAAGGCTGGCTGACATCAGTCTGAAGCTGAGGTCATGCAGCTGTGCTGTGCTGGGGAA

CAGTGAGTTTTCCAAAGTAATGAGGTCTCCAGCACCGTGGAGAACGAGACACACTAATAATACATGACCAGACGT

CAGCACAACAACAACGATGACCAGACTGTGGCAGCTTGACTGCGTCCACAAAACATGCTAGGTGTCAACTGCGGT

TGTCACCTTTTATCTTATTATTTTATTTAAAAAAAAAAAAAAAAGCTTTTCAAGTATAATGGGAAGGACTGGAGCC

AAACCCACACTGCCGCAACCTGCAGAGAGCAGGATGTTATCTAGAAAACTTGGGGGACCCATTTGTAGGCTAAAG

CCTGCCAATTCAAAAATTCTTTGTCTGATCTGAGTTGCAAAGCCACATCCTCTCCTACCATAGGCTGAGTACAAC

ATCGACAACGAAGAAGGAGTGCAAAAAAGTGATCAATACAAAAAGTAAACATCGCGGTTTGAATTGTCAAGGTTA

TTCCAGGGCAAGAGTTCATTTCCAATCATTTTTCTGCGGTTTTCACCCTACGTGGCCTAATCAAAATCGTCATTC

CAGTTTCTTCCCACACTTGCACTGGATCTCTTCCCTCCCCCAATTTTAAATGGCTGACGCAGAGGGAGGTGGTCC

TGTTTGATCCACAGCGGCAAATCTTTGTGAAGTCCAATAACTAATTGATGTAGGTCGGTTGGTACCGATCAAAAA

GCCATGTTGTTCTGAGTCCTTGGGTGGGAGTAGGTGTGTGTTCTCACCCTCATGCAGATCTCTCTTCTCCGTTCC

AGTGTCGCTGCCTCCAGCCTCTGTGAGTGGGCAAGGAGGTCATAAGGCCACGCGGATGCAGTGGTGTTTCAGCTT

GCAGGGCAGAACACCTTTGTTGAGCTGGTAGAAGTCGACCAGCTGGATCAGATCGGAGAACTTGGTGTTCCCATC

ATCCAGAGTGAAGAAGGTCTGCCCATCATCCTCGCAAGGTAAGATCTGGAAGTTTTTAATCTTCTGGTGATGGCA

CAGTGTCAGTACGAACGCCTTTGGATTACTCTGGCTGTCACGAAGGAGGAACAGCCCGTCCACGAGACCTTGTTG

CTTGATGATCCTGTGAGACTCCTCGCGGGAGATACGTCCATGGAACCAATGCTGAGTCCTGTGAATCACTGCATT

CAGGGTAGAAGGATGCAGTGGGCTTTGGCTGCTTAGGATATTCATCCGTGTGCTCCGCTTACGCCAGGCATGGCC

CTCTTCCAGGGCAGCACTCTGGGCTTCAGCCGGGTTATCGATCACTCTTCCGATTTGTCCAGAAAAATCCATGGC

CACAAGAGAATTCTCAGAAACACTGCGCATAGGTGCGTTGAAAGGAGGGGGCAGACCCTTCCTCTGTGGGATGCG

ATAGTTTTGGTACAGGAGCATTCCGTACTTGAGCAGTCTGAAGGCAGTCATCCAGCAAGTACGGATCTGCTCATC

TTCGGCACAGAGCAGACGAAGCTCCTTCATCTCGGTCTTCGCTTTGTTTGGCTTGATGCACATCCCATGTTCATT

CGGCGCGTTGTACTGCTTCTTTCCAGCAATCAGGTAGAAGATGCTGCTTTCTTCCAGGTCAGCCAGCAGCTGCAG

GTGTCTGGGTTCTTTTGAAGTCCCCTTGGTGGAGTAATAGAGGCCAGATCTGCGCAGGCACACATACAGCTTCTT

CCAAGACTTGCGTCCTACCTCTTTCACCTGCAAGAACCCCTGGATCTCAGGGCAGCTGCTGGTGTTCAGAAAATT

CTGCAGAAGCTGCGCCTGGCCACCGTTGGACTGCTGGCACCAATTGACCATCTGATCCGGGAAGAAGTTCACTGG

ATTCTTAAAGAACTCGTACTTCGCATAATTCTTTCTGAATAAGAATTTGCTCTCACTTGGCATGGTACTCTCCAC

TTGGACCACGATCTCATGGTCCTCCAGGCACCTCTCTAATCCCAGTTGTGGGTGGTGTTCCACCAGAGTCCAGCT

GTTGTCATCCACACAGTGACTTTTGTAAACCAGCAGCTGGCACAGGTCCCTGGCTGTCATGTCGGTTAGAATCTC

CACCACTTTGCTGGTCCCATCTTCACTAAAGACTTTGACATCATGCTTGGCAGGTGGCTGGCTCGGAGGAGGAGG

TAAGGAGCTAGGAGCAACCGAAGGAGGGCTCCCAGGGGCCGCACCAGTGAGCTCCGGAAATGGGTTGGGGATGGC

CGGAAGAGATGCAGTTCTTAACTGCTGGTCTTCCTCCTGAAGGCGCCTGAGAATGTGCACAGGCTGCGAGCGTTG

CATTTTCTGCCTCGGGGACGCCTGTGGCTGTCCCCGGGAGCTAGATGCTGCTCCCTGGTTGCTGGCATGCTGGCC

ATCCTCAAGAAGTGGTGCAGTATCAGTATCAGACTGCATGTTGCAAGCTGAGTTAAGGCTTTCCACGGACGAGTT

AATATCGTTGTTCATTAGTACTTGAAGCCCAAGACCATGCTCTGGTTGGCTTCTTTGTTGTGGCGAAAACCCAGA

-continued

CTTAGCTAGGTTTTCGGGTTTGGACGTTGACTGCCCCACTTTGTCCAAGGTACAGAGCTAGGACGCAGTAGATTT

CACACTCTCCTCTAACAGACAGAAACTGTAGATGGCGAT

>NM_001370603.1 *Mus musculus* growth factor receptor bound protein 10 (Grb10), transcript variant 3, mRNA

SEQ ID NO: 21

ATCGAGGGGGTGGGGTGCGGGGAGGCGGCAGGAAGGGAAGGGCGCTGCGACCAGTGGCGGGCGGGATTCGCGTTC

CGAGACCCACGGGAGCACGAAGTTTCCGCGCACCGTCTCACGCACGGCGACTGGGACCGTCCAGTGTCCGGCTTT

GCCTTCGGTTTTTCTCCGTTGTGACTCGTGCAACGTGTGGCCAGCGGCCACGCGGAGGCGACGAGGAGCTGCACG

TCAGGACAAAGTGGGGCAGTCAACGTCCAAACCCGAAAACCTAGCTAAGTCTGGGTTTTCGCCACAACAAAGAAG

CCAACCAGAGCATGGTCTTGGGCTTCAAGTACTAATGAACAACGATATTAACTCGTCCGTGGAAAGCCTTAACTC

AGCTTGCAACATGCAGTCTGATACTGATACTGCACCACTTCTTGAGGATGGCCAGCATGCCAGCAACCAGGGAGC

AGCATCTAGCTCCCGGGGACAGCCACAGGCGTCCCCGAGGCAGAAAATGCAACGCTCGCAGCCTGTGCACATTCT

CAGGCGCCTTCAGGAGGAAGACCAGCAGTTAAGAACTGCATCTCTTCCGGCCATCCCCAACCCATTTCCGGAGCT

CACTGGTGCGGCCCCTGGGAGCCCTCCTTCGGTTGCTCCTAGCTCCTTACCTCCTCCTCCGAGCCAGCCACCTGC

CAAGCATTGTGGCAGATGTGAGAAGTGGATACCAGGGGAAAATACCCGGGGAAATGGGAAACGGAAGATCTGGAG

ATGGCAGTTCCCTCCAGGCTTTCAGCTGTCGAAACTCACCCGTCCAGGTCTGTGGACAAAGACCACTGCGAGATT

TTCAAAGAAACAACCTAAGAACCAGTGTCCAACCGACACTGTGAATCCAGTGGCACGGATGCCCACTTCACAGAT

GGAGAAGCTGAGGCTCAGAAAGGATGTCAAAGTCTTTAGTGAAGATGGGACCAGCAAAGTGGTGGAGATTCTAAC

CGACATGACAGCCAGGGACCTGTGCCAGCTGCTGGTTTACAAAAGTCACTGTGTGGATGACAACAGCTGGACTCT

GGTGGAACACCACCCACAACTGGGATTAGAGAGGTGCCTGGAGGACCATGAGATCGTGGTCCAAGTGGAGAGTAC

CATGCCAAGTGAGAGCAAATTCTTATTCAGAAAGAATTATGCGAAGTACGAGTTCTTTAAGAATCCAGTGAACTT

CTTCCCGGATCAGATGGTCAATTGGTGCCAGCAGTCCAACGGTGGCCAGGCGCAGCTTCTGCAGAATTTTCTGAA

CACCAGCAGCTGCCCTGAGATCCAGGGGTTCTTGCAGGTGAAAGAGGTAGGACGCAAGTCTTGGAAGAAGCTGTA

TGTGTGCCTGCGCAGATCTGGCCTCTATTACTCCACCAAGGGGACTTCAAAAGAACCCAGACACCTGCAGCTGCT

GGCTGACCTGGAAGAAAGCAGCATCTTCTACCTGATTGCTGGAAAGAAGCAGTACAACGCGCCGAATGAACATGG

GATGTGCATCAAGCCAAACAAAGCGAAGACCGAGATGAAGGAGCTTCGTCTGCTCTGTGCCGAAGATGAGCAGAT

CCGTACTTGCTGGATGACTGCCTTCAGACTGCTCAAGTACGGAATGCTCCTGTACCAAAACTATCGCATCCCACA

GAGGAAGGGTCTGCCCCCTCCTTTCAACGCACCTATGCGCAGTGTTTCTGAGAATTCTCTTGTGGCCATGGATTT

TTCTGGACAAATCGGAAGAGTGATCGATAACCCGGCTGAAGCCCAGAGTGCTGCCCTGGAAGAGGGCCATGCCTG

GCGTAAGCGGAGCACACGGATGAATATCCTAAGCAGCCAAAGCCCACTGCATCCTTCTACCCTGAATGCAGTGAT

TCACAGGACTCAGCATTGGTTCCATGGACGTATCTCCCGCGAGGAGTCTCACAGGATCATCAAGCAACAAGGTCT

CGTGGACGGGCTGTTCCTCCTTCGTGACAGCCAGAGTAATCCAAAGGCGTTCGTACTGACACTGTGCCATCACCA

GAAGATTAAAAACTTCCAGATCTTACCTTGCGAGGATGATGGGCAGACCTTCTTCACTCTGGATGATGGGAACAC

CAAGTTCTCCGATCTGATCCAGCTGGTCGACTTCTACCAGCTCAACAAAGGTGTTCTGCCCTGCAAGCTGAAACA

CCACTGCATCCGCGTGGCCTTATGACCTCCTTGCCCACTCACAGAGGCTGGAGGCAGCGACACTGGAACGGAGAA

GAGAGATCTGCATGAGGGTGAGAACACACACCTACTCCCACCCAAGGACTCAGAACAACATGGCTTTTTGATCGG

TACCAACCGACCTACATCAATTAGTTATTGGACTTCACAAAGATTTGCCGCTGTGGATCAAACAGGACCACCTCC

CTCTGCGTCAGCCATTTAAAATTGGGGGAGGGAAGAGATCCAGTGCAAGTGTGGGAAGAAACTGGAATGACGATT

TTGATTAGGCCACGTAGGGTGAAAACCGCAGAAAAATGATTGGAAATGAACTCTTGCCCTGGAATAACCTTGACA

ATTCAAACCGCGATGTTTACTTTTTGTATTGATCACTTTTTTGCACTCCTTCTTCGTTGTCGATGTTGTACTCAG

CCTATGGTAGGAGAGGATGTGGCTTTGCAACTCAGATCAGACAAAGAATTTTTGAATTGGCAGGCTTTAGCCTAC

AAATGGGTCCCCCAAGTTTTCTAGATAACATCCTGCTCTCTGCAGGTTGCGGCAGTGTGGGTTTGGCTCCAGTCC

-continued

TTCCCATTATACTTGAAAAGCTTTTTTTTTTTTTTAAATAAAATAATAAGATAAAAGGTGACAACCGCAGTTGA
CACCTAGCATGTTTTGTGGACGCAGTCAAGCTGCCACAGTCTGGTCATCGTTGTTGTTGTGCTGACGTCTGGTCA
TGTATTATTAGTGTGTCTCGTTCTCCACGGTGCTGGAGACCTCATTACTTTGGAAAACTCACTGTTCCCCAGCAC
AGCACAGCTGCATGACCTCAGCTTCAGACTGATGTCAGCCAGCCTTCTTGGAACACATTGCTATTCATTGTGGAT
GCCACACAGTCCATCTGGGGTGCCCTGTGCCTCCCATTTTCACAGCCGCCCACTGTTGTAGAATAATCGCTGCCT
TTACCCTCTGCAGTACCCTCAGTCATTTCACTTCTCCCACAGGGGTGGGGTAGGGGTGGGGTTAAAGGATCGAAA
GAGAAAAAAACGCCAACTTGTTGGCCTTGTGCTCTGTCACTCTGAGCATCTATGGTGATAAAGAGAAGGAAACGC
TGCAGAGGCACAAGCATAAGCTGGCTTTGAGTCTTTGAAAGCTTGATGGCCTCTGCACCCTACTGAAAACCCCCT
AAGCCAGCAGGAGCAGGGTATGCAGAGGCTTTGCCTCTGCTGGCTTAGGGTGAGAAGTACCTCACAATGGATGTG
AACATTGGACAGATTTTAGGAGCATGATGTTTGCCTCCTCCGAGAGAGAGGAGTCAGAGAGAGAGAGGAGTCAGA
AGGTGGCCGGAGTTATCATTGGGTCCCCTGAGCTCCATGAAGGACCCTCTGTTGTCCCCTTGATGATTTATCAGG
CATGAGAGTAGCAGACAGGATTGCCTTGAGAAACACACAGACAACAACGGTGGTGAACACATTTCCCTTTCTTGA
TACCACCCAGAAAGTCTGCTACATACCTGAGTTAGCCACTAGATTGCCTGTCCCGACTCATTGAAGTGCTCCCCA
GGGAGCCACTTCTGATTTGCCATGGTTGACAGCATAGTGGAAGATAGATATGACAGCGCTTTGTAAAGCAGGCCA
GTGGCAAGCTGGCCCACAGTAGAGAAACACTGTAGTTCACAGACCATGCAACCGTGTTTCCACGAGATGTTATTA
CAACAAATGAAGAATTTTTTTCCTTTTTTTTCATTTTAATCTTTTTTGACTTTTTTTTAGTTAACCATTTTTTAT
GCATAAGTGCTCAAATGCATTTCTCTTTCTTTCGAAACTAGTTAATCGTTAAGTTGACAATGAGAGAATTCTCAA
GTTCATACCTGGCAGCAGGCTCCCACTGATCTTCCCCTTACAGACAGATAACAGACATTTCAGTTTTACCGTGCT
CATTTCTTTTTGCTGACTTAAGGTCAGAACTTTTACAGACAACAAACAACCCTAGGGTTTCTTTTTCCAGTTTAC
ACAGACCGGTCCCCACAGTGCAGAATCCATTTCTCTTTCGTCTCAACAGTAGACAACTAGGATGTGGATCTCATA
TTTATAAGTATGCATTTTATTTAAGAGGAAGTATAGGCTTGACTCTGGTTCACAATTTCGTACGTAGCTGGTTTG
ACGTAGAACTTTGTACTTCCCTTGCCGAAGTGAATTGTTGAAGGCTGCAACCCACCCACCTTGAGTGTAGCAGAC
TTCAGTGGCCCCGAGATCGCCAGCCCTTTGCACAGGCAGCTGGGAATTCCACCTGAAACAGCTGGTCCCTAGGTT
AGCGGGTTCCCAGCCCCCCTAATCAGAGACTGAAGGACAATTGACTTTTATTTTTGTATTTAATTGACATGAATG
TAAAGGGGACAGCTCAGGGTTGTTTTGGAGCCTGTTTGACTTTGTAATCTCTGCCTGTGATTTTCTTTTCTAAAT
GACGACTCCGTGTAACCACCTGGACTAAGTTGAGAAGGAAACTGCCAAATGCTTTGGGTTTTTAGGGTTTTAATA
GGTAGACTCTGTTCTATTATTAGGTGTTAAGAGTTTCCAAACGTGTTTTCTTTTTTCTTTTATTGTTTGCTTAAA
CTTTGAAGAAATATGTGCCTCAGCTTAGATGTTTTGTCTTCCCCTTTCTGCACTTAAATACCTGACAGCCTGTTC
GATCGCTGTGCCTCCGAGGGCGCTTCTAGCTCATCGTAGATTTGTGATGTCATAGTGCAAACTGCAGTGACCGGT
AAAATGACCTGACATGTAACCGTTTTCAGGGAATGCAGAGGGTGTTAACTAATAGACAAAACCTTTATCCCGCGT
GCTTTGCTTCACCTTGTGCTATATAGCTCTTTGGCTCGTGAACCTAATTGTAAACTTTCAGGTATTTTTGTACAA
ATAAGGGACTGATGTTCTGTTTCTTGTTATTAGAAATAAACATTAATAAAGCGTTCTTGGTGTC

>Reverse Complement of SEQ ID NO: 21

SEQ ID NO: 22

GACACCAAGAACGCTTTATTAATGTTTATTTCTAATAACAAGAAACAGAACATCAGTCCCTTATTTGTACAAAAA
TACCTGAAAGTTTACAATTAGGTTCACGAGCCAAAGAGCTATATAGCACAAGGTGAAGCAAAGCACGCGGGATAA
AGGTTTTGTCTATTAGTTAACACCCTCTGCATTCCCTGAAAACGGTTACATGTCAGGTCATTTTACCGGTCACTG
CAGTTTGCACTATGACATCACAAATCTACGATGAGCTAGAAGCGCCCTCGGAGGCACAGCGATCGAACAGGCTGT
CAGGTATTTAAGTGCAGAAAGGGGAAGACAAAACATCTAAGCTGAGGCACATATTTCTTCAAAGTTTAAGCAAAC
AATAAAAGAAAAAAGAAAACACGTTTGGAAACTCTTAACACCTAATAATAGAACAGAGTCTACCTATTAAAACCC
TAAAAACCCAAAGCATTTGGCAGTTTCCTTCTCAACTTAGTCCAGGTGGTTACACGGAGTCGTCATTTAGAAAAG
AAAATCACAGGCAGAGATTACAAAGTCAAACAGGCTCCAAAACAACCCTGAGCTGTCCCCTTTACATTCATGTCA

-continued

ATTAAATACAAAAATAAAAGTCAATTGTCCTTCAGTCTCTGATTAGGGGGGCTGGGAACCCGCTAACCTAGGGAC

CAGCTGTTTCAGGTGGAATTCCCAGCTGCCTGTGCAAAGGGCTGGCGATCTCGGGGCCACTGAAGTCTGCTACAC

TCAAGGTGGGTGGGTTGCAGCCTTCAACAATTCACTTCGGCAAGGGAAGTACAAAGTTCTACGTCAAACCAGCTA

CGTACGAAATTGTGAACCAGAGTCAAGCCTATACTTCCTCTTAAATAAAATGCATACTTATAAATATGAGATCCA

CATCCTAGTTGTCTACTGTTGAGACGAAAGAGAAATGGATTCTGCACTGTGGGGACCGGTCTGTGTAAACTGGAA

AAAGAAACCCTAGGGTTGTTTGTTGTCTGTAAAAGTTCTGACCTTAAGTCAGCAAAAAGAAATGAGCACGGTAAA

ACTGAAATGTCTGTTATCTGTCTGTAAGGGGAAGATCAGTGGGAGCCTGCTGCCAGGTATGAACTTGAGAATTCT

CTCATTGTCAACTTAACGATTAACTAGTTTCGAAAGAAAGAGAAATGCATTTGAGCACTTATGCATAAAAAAATGG

TTAACTAAAAAAAAGTCAAAAAAGATTAAAATGAAAAAAAAGGAAAAAAATTCTTCATTTGTTGTAATAACATCT

CGTGGAAACACGGTTGCATGGTCTGTGAACTACAGTGTTTCTCTACTGTGGGCCAGCTTGCCACTGGCCTGCTTT

ACAAAGCGCTGTCATATCTATCTTCCACTATGCTGTCAACCATGGCAAATCAGAAGTGGCTCCCTGGGGAGCACT

TCAATGAGTCGGGACAGGCAATCTAGTGGCTAACTCAGGTATGTAGCAGACTTTCTGGGTGGTATCAAGAAAGGG

AAATGTGTTCACCACCGTTGTTGTCTGTGTGTTTCTCAAGGCAATCCTGTCTGCTACTCTCATGCCTGATAAATC

ATCAAGGGGACAACAGAGGGTCCTTCATGGAGCTCAGGGGACCCAATGATAACTCCGGCCACCTTCTGACTCCTC

TCTCTCTCTGACTCCTCTCTCTCGGAGGAGGCAAACATCATGCTCCTAAAATCTGTCCAATGTTCACATCCATTG

TGAGGTACTTCTCACCCTAAGCCAGCAGAGGCAAAGCCTCTGCATACCCTGCTCCTGCTGGCTTAGGGGGGTTTTC

AGTAGGGTGCAGAGGCCATCAAGCTTTCAAAGACTCAAAGCCAGCTTATGCTTGTGCCTCTGCAGCGTTTCCTTC

TCTTTATCACCATAGATGCTCAGAGTGACAGAGCACAAGGCCAACAAGTTGGCGTTTTTTTCTCTTTCGATCCTT

TAACCCCACCCCTACCCCACCCCTGTGGGAGAAGTGAAATGACTGAGGGTACTGCAGAGGGTAAAGGCAGCGATT

ATTCTACAACAGTGGGCGGCTGTGAAAATGGGAGGCACAGGGCACCCCAGATGGACTGTGTGGCATCCACAATGA

ATAGCAATGTGTTCCAAGAAGGCTGGCTGACATCAGTCTGAAGCTGAGGTCATGCAGCTGTGCTGTGCTGGGGAA

CAGTGAGTTTTCCAAAGTAATGAGGTCTCCAGCACCGTGGAGAACGAGACACACTAATAATACATGACCAGACGT

CAGCACAACAACAACGATGACCAGACTGTGGCAGCTTGACTGCGTCCACAAAACATGCTAGGTGTCAACTGCGGT

TGTCACCTTTTATCTTATTATTTTATTTAAAAAAAAAAAAAAAAGCTTTTCAAGTATAATGGGAAGGACTGGAGCC

AAACCCACACTGCCGCAACCTGCAGAGAGCAGGATGTTATCTAGAAAACTTGGGGGACCCATTTGTAGGCTAAAG

CCTGCCAATTCAAAAATTCTTTGTCTGATCTGAGTTGCAAAGCCACATCCTCTCCTACCATAGGCTGAGTACAAC

ATCGACAACGAAGAAGGAGTGCAAAAAAGTGATCAATACAAAAAGTAAACATCGCGGTTTGAATTGTCAAGGTTA

TTCCAGGGCAAGAGTTCATTTCCAATCATTTTTCTGCGGTTTTCACCCTACGTGGCCTAATCAAAATCGTCATTC

CAGTTTCTTCCCACACTTGCACTGGATCTCTTCCCTCCCCCAATTTTAAATGGCTGACGCAGAGGGAGGTGGTCC

TGTTTGATCCACAGCGGCAAATCTTTGTGAAGTCCAATAACTAATTGATGTAGGTCGGTTGGTACCGATCAAAAA

GCCATGTTGTTCTGAGTCCTTGGGTGGGAGTAGGTGTGTGTTCTCACCCTCATGCAGATCTCTCTTCTCCGTTCC

AGTGTCGCTGCCTCCAGCCTCTGTGAGTGGGCAAGGAGGTCATAAGGCCACGCGGATGCAGTGGTGTTTCAGCTT

GCAGGGCAGAACACCTTTGTTGAGCTGGTAGAAGTCGACCAGCTGGATCAGATCGGAGAACTTGGTGTTCCCATC

ATCCAGAGTGAAGAAGGTCTGCCCATCATCCTCGCAAGGTAAGATCTGGAAGTTTTTAATCTTCTGGTGATGGCA

CAGTGTCAGTACGAACGCCTTTGGATTACTCTGGCTGTCACGAAGGAGGAACAGCCCGTCCACGAGACCTTGTTG

CTTGATGATCCTGTGAGACTCCTCGCGGGAGATACGTCCATGGAACCAATGCTGAGTCCTGTGAATCACTGCATT

CAGGGTAGAAGGATGCAGTGGGCTTTGGCTGCTTAGGATATTCATCCGTGTGCTCCGCTTACGCCAGGCATGGCC

CTCTTCCAGGGCAGCACTCTGGGCTTCAGCCGGGTTATCGATCACTCTTCCGATTTGTCCAGAAAAATCCATGGC

CACAAGAGAATTCTCAGAAACACTGCGCATAGGTGCGTTGAAAGGAGGGGGCAGACCCTTCCTCTGTGGGATGCG

ATAGTTTTGGTACAGGAGCATTCCGTACTTGAGCAGTCTGAAGGCAGTCATCCAGCAAGTACGGATCTGCTCATC

-continued

TTCGGCACAGAGCAGACGAAGCTCCTTCATCTCGGTCTTCGCTTTGTTTGGCTTGATGCACATCCCATGTTCATT

CGGCGCGTTGTACTGCTTCTTTCCAGCAATCAGGTAGAAGATGCTGCTTTCTTCCAGGTCAGCCAGCAGCTGCAG

GTGTCTGGGTTCTTTTGAAGTCCCCTTGGTGGAGTAATAGAGGCCAGATCTGCGCAGGCACACATACAGCTTCTT

CCAAGACTTGCGTCCTACCTCTTTCACCTGCAAGAACCCCTGGATCTCAGGGCAGCTGCTGGTGTTCAGAAAATT

CTGCAGAAGCTGCGCCTGGCCACCGTTGGACTGCTGGCACCAATTGACCATCTGATCCGGGAAGAAGTTCACTGG

ATTCTTAAAGAACTCGTACTTCGCATAATTCTTTCTGAATAAGAATTTGCTCTCACTTGGCATGGTACTCTCCAC

TTGGACCACGATCTCATGGTCCTCCAGGCACCTCTCTAATCCCAGTTGTGGGTGGTGTTCCACCAGAGTCCAGCT

GTTGTCATCCACACAGTGACTTTTGTAAACCAGCAGCTGGCACAGGTCCCTGGCTGTCATGTCGGTTAGAATCTC

CACCACTTTGCTGGTCCCATCTTCACTAAAGACTTTGACATCCTTTCTGAGCCTCAGCTTCTCCATCTGTGAAGT

GGGCATCCGTGCCACTGGATTCACAGTGTCGGTTGGACACTGGTTCTTAGGTTGTTTCTTTGAAAATCTCGCAGT

GGTCTTTGTCCACAGACCTGGACGGGTGAGTTTCGACAGCTGAAAGCCTGGAGGGAACTGCCATCTCCAGATCTT

CCGTTTCCCATTTCCCCGGGTATTTTCCCCTGGTATCCACTTCTCACATCTGCCACAATGCTTGGCAGGTGGCTG

GCTCGGAGGAGGAGGTAAGGAGCTAGGAGCAACCGAAGGAGGGCTCCCAGGGGCCGCACCAGTGAGCTCCGGAAA

TGGGTTGGGGATGGCCGGAAGAGATGCAGTTCTTAACTGCTGGTCTTCCTCCTGAAGGCGCCTGAGAATGTGCAC

AGGCTGCGAGCGTTGCATTTTCTGCCTCGGGGACGCCTGTGGCTGTCCCCGGGAGCTAGATGCTGCTCCCTGGTT

GCTGGCATGCTGGCCATCCTCAAGAAGTGGTGCAGTATCAGTATCAGACTGCATGTTGCAAGCTGAGTTAAGGCT

TTCCACGGACGAGTTAATATCGTTGTTCATTAGTACTTGAAGCCCAAGACCATGCTCTGGTTGGCTTCTTTGTTG

TGGCGAAAACCCAGACTTAGCTAGGTTTTCGGGTTTGGACGTTGACTGCCCCACTTTGTCCTGACGTGCAGCTCC

TCGTCGCCTCCGCGTGGCCGCTGGCCACACGTTGCACGAGTCACAACGGAGAAAAACCGAAGGCAAAGCCGGACA

CTGGACGGTCCCAGTCGCCGTGCGTGAGACGGTGCGCGGAAACTTCGTGCTCCCGTGGGTCTCGGAACGCGAATC

CCGCCCGCCACTGGTCGCAGCGCCCTTCCCTTCCTGCCGCCTCCCCGCACCCCACCCCCTCGAT

>NM_001109093.1 *Rattus norvegicus* growth factor receptor bound protein 10 (Grb10), mRNA

SEQ ID NO: 23

TGAGGAGAGCGGTAGAGGACCAGGGACCAGCTCAGCAGGACAGGCTTCCCAGCACCTGTGCTATAATGGGGGACA

AAGTGGGGCAGTCAACGTCCAAATCCGAAAACCTAGCTAAGTCTGGGTTTTCGCCACAACCAAGAAGCCAACCAG

AGCATGCTCTTGGGCTTCAAGTCCTAATGAACAACGATATTAACTCATCCGTGGAAAGCCTTAACTCAGCTTGCA

ACATGCAGTCTGACACTGACACTGTGCCACTTCTTGAGAATGGCCAGAGTGCCAGCAACCAGCCGTCAGCATCCA

GCTCCCGGGGACAGCCTCAGGCGTCCCCGAGGCAGAAGATGCAGCGCTCGCAGCCTGTGCACATTCAACCGCTCA

GGCGCCTTCAGGAGGAAGACCAGCAGCTCCGAACTTCATCTCTTCCGGCCATCCCCAATCCGTTTCCGGAGCTCG

CTGGGGGGGCCCCTGGGAGCCCTCCTTCGGTTGCTCCTAGCTCCTTACCTCCTCCTCCGAGCCAGCCTCCTGCCA

AGCATATGTGACAAGTGGACACCAGGGGGAAATACCCAGGGCATTGGGGAAACTGAAGATCTGGAGATGACAGAT

GGTTCCCTCCAGGCTTTCAGCTGGCGAAACTCACCCGTCCAGGTCTGTGGACAAAGACCACTGCGAGATTTTCAA

AGAGGCAACCTAAGAACCAGTGTCAAACCGACACTGCGAATGCAGTGTCACGGATTCCCACTTCACAGATGGAGA

AGCTGAGGCTCAGAAAGGATGTCAAAGTCTTTAGTGAAGATGGGACAAGCAAAGTGGTGGAGATTCTAACCGACA

TGACTGCCAGGGACCTGTGCCAGCTGCTGGTTTACAAAAGTCACTGTGTGGATGACAACAGCTGGACTCTGGTGG

AGCACCACCCACAACTGGGACTAGAGAGGTGCCTGGAGGACCATGAGATCGTGGTCCAAGTGGAGAGCACCATGC

CAAGTGAGAGTAAATTCTTATTCAGAAAGAACTATGCCAAGTACGAGTTCTTTAAGAACCCTGTGAACTTCTTTC

CGGATCAGATGGTCACCTGGTGCCAGCAGTCCAACGGTGGCCAGGCCCAGCTTCTGCAGAATTTCCTGAACTCCA

GCAGCTGCCCTGAGATCCAGGGGTTCTTGCAGGTGAAGGAGGTGGGACGCAAGTCTTGGAAGAAGCTGTATGTGT

GCCTGCGCAGATCTGGCCTTTATTACTCCACCAAGGGGACTTCAAAGGAACCCAGACACCTGCAGCTGCTGGCTG

ACCTCGAAGAAAGCAGCATCTTCTACCTGATTGCCGGAAAGAAGCAGTACAACGCACCCAATGAACACGGGATGT

-continued

GCATCAAGCCAAACAAAGCGAAGATCGAGATGAAGGAGCTGCGTCTGCTCTGTGCCGAAGATGAGCAGATCCGTA

CTTGCTGGATGACAGCCTTCAGACTGCTCAAGTATGGAATGCTCCTGTACCAAAACTATCGCATCCCGCAGCAGA

GAAAGGGTTTGGCTCCTCCTTTCAACGCGCCTATGCGCAGTGTTTCTGAGAATTCTCTTGTGGCCATGGATTTTT

CTGGACAAATTGGAAGAGTGATTGATAACCCGGCTGAAGCCCAGAGTGCTGCCCTGGAAGAGGGCCATGCCTGGC

GGAAGCGAAGCACAAGGATGAATATCCTAAGCAGCCAAAGTCCCCTTCATCCTTCGACCCTGAATTCGGTGATTC

ACAGGACTCAGCATTGGTTCCATGGACGTATCTCTCGCGAGGAATCTCACAGGATCATCAAGCAACAAGGTCTCG

TGGACGGGCTGTTCCTCCTCCGTGACAGTCAGAGCAATCCAAAGGCTTTCGTGCTGACGCTGTGTCACCAGCAGA

AGATTAGAAACTTCCAGATCTTACCCTGCGAGGATGATGGGCAAACCTTCTTCACTCTGGATGATGGGAACACCA

AGTTCTCGGATCTGATTCAGCTGGTCGACTTCTACCAGCTCAACAAAGGCGTCCTGCCCTGCAAGCTGAAGCACC

ACTGCATCCGCGTGGCCTTATGACCTCCTTGCCCACTCAGGCTGGAGGCAGCAACACTGGAACGGAGAAGAGAGG

CCTGCATGAGGGTGAGAACACACACCCACTCCCACCCAAGGACTCAGAATAACATGGCTTTCTGATCGGTACCAA

CCGACCAACATCAATTAGTTATTGGACTTTACAAAGATTTGCCGCTGCGGATCAAACAGGACCACCTCCCTCTGC

ATCAGCCATTTAAATTGGGGGAGGGAAGAGATCCAGTGCAAGTGTGGGAAGAAACTGGAATGATGATTTTGATTA

GGCCACGTAGGGTGAAAACCGCAGAGAAAAGATTGGAAATGAACTCTTGCCCTGGAATAACCTTGACAATTCAAA

CCGCGATGTTTACTTTTTGTATTGATCACTTTTTTGCACTCCTTCTTCGTTGTCAATGTTGTACTCAGCCTATGG

TAGGAGAGGATGTGGCTTTGCAACCCAGATGAGACAAAGATTTTTTGAATTGGCAGGCTTCGGCCTACAAATGGG

TCCCCCAAGTTTTCTTAGATGGCATCCTGCGCTCTGCAGGTTATGACAGTGTGGATTTGGCTCCTACATTATAGA

CACCCCAGTCCTTCCCATTATACTTGAAAAGCTTTTTTTTTTTTTTAAGAAATAATAAAATAAAAAGTGTCAAC

CGCAGTTGACACCAAGCATGTTTTGTGGACGCAGTCAAGCTGCCACAGTCTGGTCATCGTTGTTGTTGTGCTGAC

GTCTGGTCATTTATTATTAGTGTGTCTCGTTCTCCAGTGCCGGAGACCTCATTACTTTGGAAAACTCGCTGTTCC

CCAGCGCAGCACAGCCGCATGAGCTCAGCTTCAGACTGATGTCCGCCAGCCTTCTTGGAACACATTGGTATTCAT

TGTGGATGCCACACAATCCATCCGGGGTGCCTCGTGCCTCCCATTTTCACAGCCGCCCACTGTTGTAGAATGATC

GCTGCCTTTACCCTCTGCAGTAGCCTCCGCCATTTCAGTTCTCCCACAGGGGTGGGGTGGGGGTGGGGTTAAAGG

ATCGAAAGAGAAAAATGCCAACTTGTTGGCCTTGTGCTCTTGTCACTCTGAGCATGTTTGGTGATTAAAGAGAAG

GAAACACTGCAGAGGCACAGGCATAGGCTGGCTTTGAGTCTTCGCTTGATGACCTCTGCACCCTACTGAAAACCC

CCTAAGCCAGCCGGAGCAGGGTATGAAGAGGTCCTGCCTCTGCTGGCTTAGGGTGAGAAGTACCTCACAGTGGTT

GTGAACATTGGATAGTTTTTAGGAGGATGATGTTTGCCTCCTTTGAGAAAGGAGTCAGAAGGTGGCCGGAGTGAT

CATTGGTCCCCTGAGCTCCATGGAGGACCCTCTGTTGTCCCCTTGATGATTCATCAGGCATGAGAGTAGCAGACA

GGACTCCCTTGAGGAACACAGACAGCTGTGGTGATCACATTTATTTCCCTTTCTTGACACCACACAGGAAGTCTG

CTACACACCTGAGCTAGCCACTAGATTGCCTGTCCCGACTGCGCGAAGTGCTCCCCAGGGAGCCACTTCTGATTG

CGCTGCGGTTGACGGCCCGGTGGAAGATTAATGACAGCGCTTTGTAACGCAGGCCAGCGGCACGCTGGTCCACGG

TGTAGGAACACTGTAGTTCACAGACCACGCAACCGTGTTTCCACGAGATGTTATTACAACAAATGAAGAATTTTT

TTCCTTTTTTTCATTTTAATCTTTTTTGACTTTTTTTTAGTAAAACATTTTCTTACGCATAAACGCTCAATTGCA

TTTCTCTTTCTTTCGCAGCTAGTTAATCATTCAGTTGACAATGAGAGAATTCTCAAGTTCATACTTGGCAGCAGG

CTCCCACTGATCTTCCCCTTGAGACAAATAGTGGACATTTCAGTTTTACCATATTCATTTCTTTCCGCTGACTTC

GAGGTCAGACCTTTACAAACAGATAACAAACAGCCCTAGGATTTCTTTCTCCAGTTTACACAGACCAGTCCCCAC

AGTGCATAACCCTTTACTCTTCTGCCTCTACAGTAGACAGCTAAGATGTGTATCTCATATTTATAAGTACGCATT

CTATTTAAGCGGAAGTATAGGCTTGACTCTGGTTCACAATTTTGTACGTAGCTGGTTTGACGTAGTATTTTGTAC

TTCCCTTGCTGAAGTGAATTGTTGAAGGCTGCAAGCCACCCGCCTTGAGTGCAGCAGACTTCAGTGACCCCGAGC

TCGCTCACCAGCCTTTGCACAGGTAGCTGGGAATTCCACCAGAAACAGCTGGTCCCTAGGTTAGCGGGCACCCAG

CCGCCCCTAACCGGAGACTGAAGGACAATTGACTTTTATTTTTGTATTTAATTGACATGAATGTAAGGGGACAGC

-continued

TCAGGGTTGTTTGGAGCCTGTTTGACTTTGCAATCTCTGCCTGTGATTTTCTTTTCTTAAGAACAACTCCGTGTA

ACCACCTGGACTAAGTTGAGAAGGAAAATGCCAAATGCTTTGGGTTTTTAGCGTTTTAATACGTAGGCTCTGTTA

TATTATTAGGTGTTAAGAGTTTCCAAACGTGTTTTCTTTTTTCTTTTTTTGTTTGCTTAAACTTTGAAGAAAATAT

GTGCCTCAGCTTAGATGTTTTGTCTTCTCCTTTCTGCACTTAAATACCTGACAGCCTGTCCGATCACTGTGCCTC

CGAGGGCGCTACTAGCTCATCGTAGATTTGTGATATCATAGTGTAAACTGCAGTGACCGGAAAATGACCTGACAT

GTAAACGTTTTCAGGGAATGCAGAGGGTGTTAATTGATAGACAAAACCTTTATCCCGCGTGCTTTGCTTCACTCT

GTGCTATATAGCTCTTTGGCTCGTGAACCTAATTGTAAACTTTCAGGTATTTTTGTACAAATAAGGGACTGATGT

TCTGTTTCTTGTTATTAGAAATAAACATTAATAAAGTGTTCTTCAT

>Reverse Complement of SEQ ID NO: 23

SEQ ID NO: 24

ATGAAGAACACTTTATTAATGTTTATTTCTAATAACAAGAAACAGAACATCAGTCCCTTATTTGTACAAAAATAC

CTGAAAGTTTACAATTAGGTTCACGAGCCAAAGAGCTATATAGCACAGAGTGAAGCAAAGCACGCGGGATAAAGG

TTTTGTCTATCAATTAACACCCTCTGCATTCCCTGAAAACGTTTACATGTCAGGTCATTTTCCGGTCACTGCAGT

TTACACTATGATATCACAAATCTACGATGAGCTAGTAGCGCCCTCGGAGGCACAGTGATCGGACAGGCTGTCAGG

TATTTAAGTGCAGAAAGGAGAAGACAAAACATCTAAGCTGAGGCACATATTTTCTTCAAAGTTTAAGCAAACAAAA

AAAGAAAAAAGAAAACACGTTTGGAAACTCTTAACACCTAATAATATAACAGAGCCTACGTATTAAAACGCTAAA

AACCCAAAGCATTTGGCATTTTCCTTCTCAACTTAGTCCAGGTGGTTACACGGAGTTGTTCTTAAGAAAAGAAAA

TCACAGGCAGAGATTGCAAAGTCAAACAGGCTCCAAACAACCCTGAGCTGTCCCCTTACATTCATGTCAATTAAA

TACAAAAATAAAAGTCAATTGTCCTTCAGTCTCCGGTTAGGGGCGGCTGGGTGCCCGCTAACCTAGGGACCAGCT

GTTTCTGGTGGAATTCCCAGCTACCTGTGCAAAGGCTGGTGAGCGAGCTCGGGGTCACTGAAGTCTGCTGCACTC

AAGGCGGGTGGCTTGCAGCCTTCAACAATTCACTTCAGCAAGGGAAGTACAAAATACTACGTCAAACCAGCTACG

TACAAAATTGTGAACCAGAGTCAAGCCTATACTTCCGCTTAAATAGAATGCGTACTTATAAATATGAGATACACA

TCTTAGCTGTCTACTGTAGAGGCAGAAGAGTAAAGGGTTATGCACTGTGGGGACTGGTCTGTGTAAACTGGAGAA

AGAAATCCTAGGGCTGTTTGTTATCTGTTTGTAAAGGTCTGACCTCGAAGTCAGCGGAAAGAAATGAATATGGTA

AAACTGAAATGTCCACTATTTGTCTCAAGGGGAAGATCAGTGGGAGCCTGCTGCCAAGTATGAACTTGAGAATTC

TCTCATTGTCAACTGAATGATTAACTAGCTGCGAAAGAAAGAGAAATGCAATTGAGCGTTTATGCGTAAGAAAAT

GTTTTACTAAAAAAAAGTCAAAAAAGATTAAAATGAAAAAAAGGAAAAAAATTCTTCATTTGTTGTAATAACATC

TCGTGGAAACACGGTTGCGTGGTCTGTGAACTACAGTGTTCCTACACCGTGGACCAGCGTGCCGCTGGCCTGCGT

TACAAAGCGCTGTCATTAATCTTCCACCGGGCCGTCAACCGCAGCGCAATCAGAAGTGGCTCCCTGGGGAGCACT

TCGCGCAGTCGGGACAGGCAATCTAGTGGCTAGCTCAGGTGTGTAGCAGACTTCCTGTGTGGTGTCAAGAAAGGG

AAATAAATGTGATCACCACAGCTGTCTGTGTTCCTCAAGGGAGTCCTGTCTGCTACTCTCATGCCTGATGAATCA

TCAAGGGGACAACAGAGGGTCCTCCATGGAGCTCAGGGGACCAATGATCACTCCGGCCACCTTCTGACTCCTTTC

TCAAAGGAGGCAAACATCATCCTCCTAAAAACTATCCAATGTTCACAACCACTGTGAGGTACTTCTCACCCTAAG

CCAGCAGAGGCAGGACCTCTTCATACCCTGCTCCGGCTGGCTTAGGGGGTTTTCAGTAGGGTGCAGAGGTCATCA

AGCGAAGACTCAAAGCCAGCCTATGCCTGTGCCTCTGCAGTGTTTCCTTCTCTTTAATCACCAAACATGCTCAGA

GTGACAAGAGCACAAGGCCAACAAGTTGGCATTTTTCTCTTTCGATCCTTTAACCCCACCCCCACCCCACCCCTG

TGGGAGAACTGAAATGGCGGAGGCTACTGCAGAGGGTAAAGGCAGCGATCATTCTACAACAGTGGGCGGCTGTGA

AAATGGGAGGCACGAGGCACCCCGGATGGATTGTGTGGCATCCACAATGAATACCAATGTGTTCCAAGAAGGCTG

GCGGACATCAGTCTGAAGCTGAGCTCATGCGGCTGTGCTGCGCTGGGGAACAGCGAGTTTTCCAAAGTAATGAGG

TCTCCGGCACTGGAGAACGAGACACACTAATAATAAATGACCAGACGTCAGCACAACAACAACGATGACCAGACT

GTGGCAGCTTGACTGCGTCCACAAAACATGCTTGGTGTCAACTGCGGTTGACACTTTTTATTTTATTATTTCTTA

-continued

AAAAAAAAAAAAAAGCTTTTCAAGTATAATGGGAAGGACTGGGGTGTCTATAATGTAGGAGCCAAATCCACACTG

TCATAACCTGCAGAGCGCAGGATGCCATCTAAGAAAACTTGGGGGACCCATTTGTAGGCCGAAGCCTGCCAATTC

AAAAAATCTTTGTCTCATCTGGGTTGCAAAGCCACATCCTCTCCTACCATAGGCTGAGTACAACATTGACAACGA

AGAAGGAGTGCAAAAAAGTGATCAATACAAAAAGTAAACATCGCGGTTTGAATTGTCAAGGTTATTCCAGGGCAA

GAGTTCATTTCCAATCTTTTCTCTGCGGTTTTCACCCTACGTGGCCTAATCAAAATCATCATTCCAGTTTCTTCC

CACACTTGCACTGGATCTCTTCCCTCCCCCAATTTAAATGGCTGATGCAGAGGGAGGTGGTCCTGTTTGATCCGC

AGCGGCAAATCTTTGTAAAGTCCAATAACTAATTGATGTTGGTCGGTTGGTACCGATCAGAAAGCCATGTTATTC

TGAGTCCTTGGGTGGGAGTGGGTGTGTGTTCTCACCCTCATGCAGGCCTCTCTTCTCCGTTCCAGTGTTGCTGCC

TCCAGCCTGAGTGGGCAAGGAGGTCATAAGGCCACGCGGATGCAGTGGTGCTTCAGCTTGCAGGGCAGGACGCCT

TTGTTGAGCTGGTAGAAGTCGACCAGCTGAATCAGATCCGAGAACTTGGTGTTCCCATCATCCAGAGTGAAGAAG

GTTTGCCCATCATCCTCGCAGGGTAAGATCTGGAAGTTTCTAATCTTCTGCTGGTGACACAGCGTCAGCACGAAA

GCCTTTGGATTGCTCTGACTGTCACGGAGGAGGAACAGCCCGTCCACGAGACCTTGTTGCTTGATGATCCTGTGA

GATTCCTCGCGAGAGATACGTCCATGGAACCAATGCTGAGTCCTGTGAATCACCGAATTCAGGGTCGAAGGATGA

AGGGGACTTTGGCTGCTTAGGATATTCATCCTTGTGCTTCGCTTCCGCCAGGCATGGCCCTCTTCCAGGGCAGCA

CTCTGGGCTTCAGCCGGGTTATCAATCACTCTTCCAATTTGTCCAGAAAAATCCATGGCCACAAGAGAATTCTCA

GAAACACTGCGCATAGGCGCGTTGAAAGGAGGAGCCAAACCCTTTCTCTGCTGCGGGATGCGATAGTTTTGGTAC

AGGAGCATTCCATACTTGAGCAGTCTGAAGGCTGTCATCCAGCAAGTACGGATCTGCTCATCTTCGGCACAGAGC

AGACGCAGCTCCTTCATCTCGATCTTCGCTTTGTTTGGCTTGATGCACATCCCGTGTTCATTGGGTGCGTTGTAC

TGCTTCTTTCCGGCAATCAGGTAGAAGATGCTGCTTTCTTCGAGGTCAGCCAGCAGCTGCAGGTGTCTGGGTTCC

TTTGAAGTCCCCTTGGTGGAGTAATAAAGGCCAGATCTGCGCAGGCACACATACAGCTTCTTCCAAGACTTGCGT

CCCACCTCCTTCACCTGCAAGAACCCCTGGATCTCAGGGCAGCTGCTGGAGTTCAGGAAATTCTGCAGAAGCTGG

GCCTGGCCACCGTTGGACTGCTGGCACCAGGTGACCATCTGATCCGGAAAGAAGTTCACAGGGTTCTTAAAGAAC

TCGTACTTGGCATAGTTCTTTCTGAATAAGAATTTACTCTCACTTGGCATGGTGCTCTCCACTTGGACCACGATC

TCATGGTCCTCCAGGCACCTCTCTAGTCCCAGTTGTGGGTGGTGCTCCACCAGAGTCCAGCTGTTGTCATCCACA

CAGTGACTTTTGTAAACCAGCAGCTGGCACAGGTCCCTGGCAGTCATGTCGGTTAGAATCTCCACCACTTTGCTT

GTCCCATCTTCACTAAAGACTTTGACATCCTTTCTGAGCCTCAGCTTCTCCATCTGTGAAGTGGGAATCCGTGAC

ACTGCATTCGCAGTGTCGGTTTGACACTGGTTCTTAGGTTGCCTCTTTGAAAATCTCGCAGTGGTCTTTGTCCAC

AGACCTGGACGGGTGAGTTTCGCCAGCTGAAAGCCTGGAGGGAACCATCTGTCATCTCCAGATCTTCAGTTTCCC

CAATGCCCTGGGTATTTCCCCCTGGTGTCCACTTGTCACATATGCTTGGCAGGAGGCTGGCTCGGAGGAGGAGGT

AAGGAGCTAGGAGCAACCGAAGGAGGGCTCCCAGGGGCCCCCCCAGCGAGCTCCGGAAACGGATTGGGGATGGCC

GGAAGAGATGAAGTTCGGAGCTGCTGGTCTTCCTCCTGAAGGCGCCTGAGCGGTTGAATGTGCACAGGCTGCGAG

CGCTGCATCTTCTGCCTCGGGGACGCCTGAGGCTGTCCCCGGGAGCTGGATGCTGACGGCTGGTTGCTGGCACTC

TGGCCATTCTCAAGAAGTGGCACAGTGTCAGTGTCAGACTGCATGTTGCAAGCTGAGTTAAGGCTTTCCACGGAT

GAGTTAATATCGTTGTTCATTAGGACTTGAAGCCCAAGAGCATGCTCTGGTTGGCTTCTTGGTTGTGGCGAAAAC

CCAGACTTAGCTAGGTTTTCGGATTTGGACGTTGACTGCCCCACTTTGTCCCCCATTATAGCACAGGTGCTGGGA

AGCCTGTCCTGCTGAGCTGGTCCCTGGTCCTCTACCGCTCTCCTCA

>NM_001257428.1 *Macaca mulatta* growth factor receptor bound protein 10 (GRB10), mRNA

SEQ ID NO: 25

ATTTGAAGAAGGCAGAAGGAACCCATGGCTTTAGCTGGCTGCCCAGATTCCTTTTTGCACCATCCGTACTACCAG

GACAAGGTGGAGCAGACACCTCGCAGTCAACAAGACCCGGCAGGACCAGGACTCCCCGCACAGTCTGACCGACTC

ACACATCACCAGGAGGATGATGTGGACCTGGAAGCCCTGGTGAACGATATGAACGCATCCCTGGATAGCCTGTAC

-continued

TCAGCCTGCAGCATGCAGTCAGACACAGTGCCCCTCCTGCAGAATGGCCAGCATGACCGCAGCCAACCTCGGGCT

TCAGGCCCTCGGTCCGTCCAGCCACAGGTGTCCCCGAGGCAGAGGGTGCAGCGCTCCCAGCCTGTGCACATACTT

GCTGTCAGGCGCCTTCAGGAGGAAGACCAGCAATTTAGAACCTCGTCTCTGCCGGCCATCCCGAATCCTTTTCCT

GAACTCTGTGGCCCTGGGAGCCCCCCTGTGCTCACGCCGGGTTCTTTACCTCCGAGCCAGGCCGCCGCAAAGCAG

GATGTTAAAGTCTTTAGTGAAGATGGGACGAGCAAAGTGGTGGAGATTCTAGCAGACATGACAGCCAGGGACCTG

TGCCAATTGCTGGTTTACAAAAGTCACTGTGTGGATGACAACAGCTGGACACTAGTGGAGCACCACCCGCACCTA

GGATTAGAGAGGTGCTTGGAAGACCACGAGCTGGTGGTCCAAGTGGAGAGTACCATGGCCAGTGAGAGTAAATTT

CTATTCAGGAAGAATTATGCAAAATACGAGTTCTTTAAAAATCCCATGAATTTCTTCCCAGAACAGATGGTTACT

TGGTGCCAGCAGTCAAATGGCAGTCAAAGCCAGCTTTTGCAGAATTTTCTGAACTCCAGTAGCTGTCCTGAAATT

CAAGGGTTTTTGCATGTGAAAGAGCTGGGAAAGAAATCATGGAAAAAGCTGTATGTGTGTTTGCGGAGATCTGGC

CTTTATTGCTCCACCAAGGGAACTTCAAAGGAACCCAGACACCTGCAGCTGCTGGCCGACCTGGAGGACAGCAAC

ATCTTCTCCCTGATCGCCGGCAGGAAGCAGTACAGCGCCCCTACAGACCACGGGCTCTGCATAAAGCCAAACAAA

GTCAGGAATGAAGCTAAAGAGCTGAGGTTGCTCTGTGCAGAGGATGAGCAAACCAGGACGTGCTGGATGACAGCG

TTCAGACTCCTGAAGTATGGAATGCTCCTTTACCAGAACTACCGAATCCCTCAGCAGAGGAAGGCCTTGCTATCC

CCGTTCTCAACGCCAGTGCGCAGTGTCTCCGAGAACTCCCTCGTGGCAATGGATTTTTCTGGGCAAACAGGACGC

GTGATAGAGAATCCGGCGGAGGCCCAGAGCGCAGCCCTGGAGGAGGGCCACGCCTGGAGGAAGCGAAGCACACGG

ATGAACATCCTAGGTAGCCAAAGTCCCCTCCACCCTTCTACCCTAAGTACAGTGATTCACAGGACACAGCACTGG

TTTCACGGGAGGATCTCCAGGGAGGAATCCCACAGGATCATTAAACAGCAAGGGCTCGTGGACGGGCTTTTTCTC

CTCCGTGACAGCCAGAGTAATCCAAAGGCATTTGTACTCACACTGTGTCATCACCAGAAAATTAAAAATTTCCAG

ATCTTACCTTGCGAGGATGATGGGCAGACGTTCTTCAGCCTAGATGACGGGAACACCAAATTCTCTGACCTGATC

CAGCTGGTTGACTTTTACCAGCTGAACAAAGGAGTCCTGCCTTGCAAACTCAAGCACCACTGCATCCGAGTGGCC

TTATGACCGCAGATGTCCTCTCGGCTGAAGATTGGAGGAAGTGAACACTGGACTGAAGAAGCGGTCTGTGCATTG

GTTAAGAACACACATTGATTCTGCACCTGGGGACCCAAAGCGAGATGGGTTCGTTCAGTGCCAGCCAACCAAGAT

TGACTAGTTTGTTGGACTTAAATGACGATTTGCTGCTGTGAACCCAGCAGGGTCGCCTCCCTCTGCGTCGGCCAA

ATTGGGGAGGGCTTGGAAGATCCAGCGGAAATTTGAAAATAAACTGGAATGATCATTTTGGCTTGGGCCGCTTAG

GAGCAAGAACCAGAGAGAAATGATTGGAAATGAACTCTTGCCCTGGAATAATCTTGACAATTAAAACTGATATGT

TTACTTTTTTTGTATTGATCACTTTTTTGCACTCCTTCTTTGTTTTCAATATTGTATTCAGCCTATGGTAGGAGG

GGGATGTGGCGTTTCAACTCATATAATACAGAAAGAGTTTCGAACGGGCAGACTTCAAACTGAGTATGGGTCCCC

AAATGTTCCCAGAGGGTCCTCCGCACCCTCTGCCAAATACCACGGTGTGGATTCAGCTCCCAAATGACAAACCCA

GCCCTTCCCAGTATACTTGAAAAGCTTTTCTGTTAAAATAAAAGGTGTCACTGTGGTAGGCATTTGGCATGTTTT

GTGGACTCAGTCAAGCAACCACAGTCTGTTAATCATTTCTCTATGCTCAGATGTCAGATCCTCTTGTTATTAGCG

TGTCTTGTTCTGCACAGTGCAGGAGACTTTATTCCTTTGGAAAATTCACTGTTCCACAAACAGCAGGCTGAATGG

CCTCGCCTCTAGACTGACGTGGGCCAGCCTCCTTGAGACACACCTGGCACCCGTCATCGGCCAGCGGTGGATGCT

GCATAATCCACCTGGGTACTTTCAGCCTTGCGTTTCCACGGCCTTCAGCCTGTTCTAGAACGATCACTGCCTTAC

CCCTGCTGCTGCAGTGGTGTGAGTCGTTTCACGGCTGATGTCCCTCGGGGGATTAAAGGATCTAAAGAGAGAATG

GCACCTGGTTGGCTTCGTGCTGTGTCTCGTGGGTTTCCATGGTGATAAAGACAAGGAAACGCTGCAGAGGTCACA

GGCACAGGGTGATATTTAAAGATCTTTGCTTGCAGCCCTCCGTCCTGCTGAGAACCCCCATAAGCCAGTGAACGC

AGAGCCCTTAGAGGCTCCTCTGCTGGCTTAGGGTGCAGAGTACCTCACGGTGGTTGTGGACATGGAAGAGTTTTG

TCAACACAACACTTCCTCCCTGCTCCGGGAGATGAGTCAGACGGTGGCTTGAGTTGTCACTTGGTCCCCTCCGCC

CCTCGGGTGGCCCCCTTTGCCATGTCCCCTTAGCTTAGTGATCAGGTGTGAGAGTGGCCATTTCCTTACCTTTGA

TCCCTGCAAAGCAGAAAGGACTCCCTTGACAAGGAACAGACTACCGTGGTGAGCAGAACGATTTCCTTTTTCAAG

-continued

ACAATACCCGCCTGGCTTCTCTGAATCTGTGCTAGCCACGATATTGCCCCAACTCCGCTCCCACTGAAGTGCTCC

CTAAGGAACAGCATTTCTCTGCTCGTCAGTCAACCCCCATAGCCTAGAGCAGTGTCACGAGCTTCAGTAAGGCCA

ATCAGCTGGAAGTCAGTGTACCATATAGTAACACTGTATTTCAGTTTACAGACCACACTCTAGCTGTTTTCCATA

AAAGGTATACAAATAAAGAATTTTTTAGCAAAACATGTTTTTAACCATCAATGCTCAATTGCATTTTCTTCCTTT

CGCAGCCAGTCAGTCTTTCGAACTATTGACAGTGAGATAATTCTCGTGTTCACACCTGGCGGCAGGCTTCACTAT

AGGGACGGACATTGCAGTTACACCGCGATTCCTTTCTCTTCACTGGCTCGAGGTAAACACTTTCCAAGGAAAAAC

AACTCTAGGATTTCTTTTTTCTGTGTACGTAGACCAGTCCCATCAGTGTATAATCTCTCTCTTTCACGCCTCTCT

CCAATAGACAGCTTGTATTTGCAGTATTTCATATTTATAAATGCGCGTTTATTTAAAAGGAGAACAAAAGCTTGA

CTCTGATTCACAGTTTTGTATGTAGCTGGTTTGACGTAGTCTTTTGTATTTTCCCTGCCGAAGTGAATTGTTGGA

GAATGTAAACCGCCTCCGTGCGGCAGCAGACTTCCTAAGGCCCCAGCTCGCTAGCCTCGTGCTGGGCAGCTGGGA

ATTCCACCTGAGAACAAGTCCCGCAAACCGGGGACGGAAGGACATTTGACTTTTATTTTTGTATTTAATTGACAT

GAATGTAAAGGGGACAGCTCAGGGTTGTTTTGGAGCCTGTTGACTTTGTATCTCTGCCTGTGATTTTCTTTTCTA

AATGAAACTCCATGTAGCAACCGGGATGAAGTTGAGAAGGAAAACGCCAAATGCTTTGGTTATTAGAGTTTAATA

GGTAAGCTCTGTTACACTAGGTGTTAGAGTTCCAGAATGTTCTTTTGTTTGCTAAACCTTGAAGAAACATGTGCC

TCAGCCTAGATGTTTTGTCTTCTCTTTTCTGCACTTAATACCTGACAGTATGACCGATCTCTGCGCCTTTCCGGG

GGCGGGCCAGCTGGCGGTAGATTTGTGATGTCACAGTGCAAACTGCAGCGACTGTAAATCGGCCTGGCGTGTATA

AACGTTTTCAGGGAATGCAGAAGGTATTAATGAAGAGACAAAACCTTTATTCCATGTGCTTTGCTTCATTCTGTA

CATAGCTCTTTGGCTCGTGAACCTAATTGTAAACTTTCAGGTATTTTTGTACAAATAAGGGACTGATGTTCTGTT

TCTTGTAATTAGAAATAAACATTAATACAGTGTTCTTCATTTTCAAAAAAAA

>Reverse Complement of SEQ ID NO: 25

SEQ ID NO: 26

TTTTTTTTGAAAATGAAGAACACTGTATTAATGTTTATTTCTAATTACAAGAAACAGAACATCAGTCCCTTATTT

GTACAAAAATACCTGAAAGTTTACAATTAGGTTCACGAGCCAAAGAGCTATGTACAGAATGAAGCAAAGCACATG

GAATAAAGGTTTTGTCTCTTCATTAATACCTTCTGCATTCCCTGAAAACGTTTATACACGCCAGGCCGATTTACA

GTCGCTGCAGTTTGCACTGTGACATCACAAATCTACCGCCAGCTGGCCCGCCCCCGGAAAGGCGCAGAGATCGGT

CATACTGTCAGGTATTAAGTGCAGAAAAGAGAAGACAAAACATCTAGGCTGAGGCACATGTTTCTTCAAGGTTTA

GCAAACAAAAGAACATTCTGGAACTCTAACACCTAGTGTAACAGAGCTTACCTATTAAACTCTAATAACCAAAGC

ATTTGGCGTTTTCCTTCTCAACTTCATCCCGGTTGCTACATGGAGTTTCATTTAGAAAAGAAAATCACAGGCAGA

GATACAAAGTCAACAGGCTCCAAAACAACCCTGAGCTGTCCCCTTTACATTCATGTCAATTAAATACAAAAATAA

AAGTCAAATGTCCTTCCGTCCCCGGTTTGCGGGACTTGTTCTCAGGTGGAATTCCCAGCTGCCCAGCACGAGGCT

AGCGAGCTGGGGCCTTAGGAAGTCTGCTGCCGCACGGAGGCGGTTTACATTCTCCAACAATTCACTTCGGCAGGG

AAAATACAAAAGACTACGTCAAACCAGCTACATACAAAACTGTGAATCAGAGTCAAGCTTTTGTTCTCCTTTTAA

ATAAACGCGCATTTATAAATATGAAATACTGCAAATACAAGCTGTCTATTGGAGAGAGGCGTGAAAGAGAGAGAT

TATACACTGATGGGACTGGTCTACGTACACAGAAAAAAGAAATCCTAGAGTTGTTTTTCCTTGGAAAGTGTTTAC

CTCGAGCCAGTGAAGAGAAAGGAATCGCGGTGTAACTGCAATGTCCGTCCCTATAGTGAAGCCTGCCGCCAGGTG

TGAACACGAGAATTATCTCACTGTCAATAGTTCGAAAGACTGACTGGCTGCGAAAGGAAGAAAATGCAATTGAGC

ATTGATGGTTAAAAACATGTTTTGCTAAAAAATTCTTTATTTGTATACCTTTTATGGAAAACAGCTAGAGTGTGG

TCTGTAAACTGAAATACAGTGTTACTATATGGTACACTGACTTCCAGCTGATTGGCCTTACTGAAGCTCGTGACA

CTGCTCTAGGCTATGGGGGTTGACTGACGAGCAGAGAAATGCTGTTCCTTAGGGAGCACTTCAGTGGGAGCGGAG

TTGGGGCAATATCGTGGCTAGCACAGATTCAGAGAAGCCAGGCGGGTATTGTCTTGAAAAAGGAAATCGTTCTGC

TCACCACGGTAGTCTGTTCCTTGTCAAGGGAGTCCTTTCTGCTTTGCAGGGATCAAAGGTAAGGAAATGGCCACT

-continued

CTCACACCTGATCACTAAGCTAAGGGGACATGGCAAAGGGGGCCACCCGAGGGGCGGAGGGGACCAAGTGACAAC

TCAAGCCACCGTCTGACTCATCTCCCGGAGCAGGGAGGAAGTGTTGTGTTGACAAAACTCTTCCATGTCCACAAC

CACCGTGAGGTACTCTGCACCCTAAGCCAGCAGAGGAGCCTCTAAGGGCTCTGCGTTCACTGGCTTATGGGGTT

CTCAGCAGGACGGAGGGCTGCAAGCAAAGATCTTTAAATATCACCCTGTGCCTGTGACCTCTGCAGCGTTTCCTT

GTCTTTATCACCATGGAAACCCACGAGACACAGCACGAAGCCAACCAGGTGCCATTCTCTCTTTAGATCCTTTAA

TCCCCCGAGGGACATCAGCCGTGAAACGACTCACACCACTGCAGCAGCAGGGGTAAGGCAGTGATCGTTCTAGAA

CAGGCTGAAGGCCGTGGAAACGCAAGGCTGAAAGTACCCAGGTGGATTATGCAGCATCCACCGCTGGCCGATGAC

GGGTGCCAGGTGTGTCTCAAGGAGGCTGGCCCACGTCAGTCTAGAGGCGAGGCCATTCAGCCTGCTGTTTGTGGA

ACAGTGAATTTTCCAAAGGAATAAAGTCTCCTGCACTGTGCAGAACAAGACACGCTAATAACAAGAGGATCTGAC

ATCTGAGCATAGAGAAATGATTAACAGACTGTGGTTGCTTGACTGAGTCCACAAAACATGCCAAATGCCTACCAC

AGTGACACCTTTTATTTTAACAGAAAAGCTTTTCAAGTATACTGGGAAGGGCTGGGTTTGTCATTTGGGAGCTGA

ATCCACACCGTGGTATTTGGCAGAGGGTGCGGAGGACCCTCTGGGAACATTTGGGGACCCATACTCAGTTTGAAG

TCTGCCCGTTCGAAACTCTTTCTGTATTATATGAGTTGAAACGCCACATCCCCCTCCTACCATAGGCTGAATACA

ATATTGAAAACAAAGAAGGAGTGCAAAAAAGTGATCAATACAAAAAAAGTAAACATATCAGTTTTAATTGTCAAG

ATTATTCCAGGGCAAGAGTTCATTTCCAATCATTTCTCTCTGGTTCTTGCTCCTAAGCGGCCCAAGCCAAAATGA

TCATTCCAGTTTATTTTCAAATTTCCGCTGGATCTTCCAAGCCCTCCCCAATTTGGCCGACGCAGAGGGAGGCGA

CCCTGCTGGGTTCACAGCAGCAAATCGTCATTTAAGTCCAACAAACTAGTCAATCTTGGTTGGCTGGCACTGAAC

GAACCCATCTCGCTTTGGGTCCCCAGGTGCAGAATCAATGTGTGTTCTTAACCAATGCACAGACCGCTTCTTCAG

TCCAGTGTTCACTTCCTCCAATCTTCAGCCGAGAGGACATCTGCGGTCATAAGGCCACTCGGATGCAGTGGTGCT

TGAGTTTGCAAGGCAGGACTCCTTTGTTCAGCTGGTAAAAGTCAACCAGCTGGATCAGGTCAGAGAATTTGGTGT

TCCCGTCATCTAGGCTGAAGAACGTCTGCCCATCATCCTCGCAAGGTAAGATCTGGAAATTTTTAATTTTCTGGT

GATGACACAGTGTGAGTACAAATGCCTTTGGATTACTCTGGCTGTCACGGAGGAGAAAAAGCCCGTCCACGAGCC

CTTGCTGTTTAATGATCCTGTGGGATTCCTCCCTGGAGATCCTCCCGTGAAACCAGTGCTGTGTCCTGTGAATCA

CTGTACTTAGGGTAGAAGGGTGGAGGGGACTTTGGCTACCTAGGATGTTCATCCGTGTGCTTCGCTTCCTCCAGG

CGTGGCCCTCCTCCAGGGCTGCGCTCTGGGCCTCCGCCGGATTCTCTATCACGCGTCCTGTTTGCCCAGAAAAAT

CCATTGCCACGAGGGAGTTCTCGGAGACACTGCGCACTGGCGTTGAGAACGGGGATAGCAAGGCCTTCCTCTGCT

GAGGGATTCGGTAGTTCTGGTAAAGGAGCATTCCATACTTCAGGAGTCTGAACGCTGTCATCCAGCACGTCCTGG

TTTGCTCATCCTCTGCACAGAGCAACCTCAGCTCTTTAGCTTCATTCCTGACTTTGTTTGGCTTTATGCAGAGCC

CGTGGTCTGTAGGGGCGCTGTACTGCTTCCTGCCGGCGATCAGGGAGAAGATGTTGCTGTCCTCCAGGTCGGCCA

GCAGCTGCAGGTGTCTGGGTTCCTTTGAAGTTCCCTTGGTGGAGCAATAAAGGCCAGATCTCCGCAAACACACAT

ACAGCTTTTTCCATGATTTCTTTCCCAGCTCTTTCACATGCAAAAACCCTTGAATTTCAGGACAGCTACTGGAGT

TCAGAAAATTCTGCAAAAGCTGGCTTTGACTGCCATTTGACTGCTGGCACCAAGTAACCATCTGTTCTGGGAAGA

AATTCATGGGATTTTTAAAGAACTCGTATTTTGCATAATTCTTCCTGAATAGAAATTTACTCTCACTGGCCATGG

TACTCTCCACTTGGACCACCAGCTCGTGGTCTTCCAAGCACCTCTCTAATCCTAGGTGCGGGTGGTGCTCCACTA

GTGTCCAGCTGTTGTCATCCACACAGTGACTTTTGTAAACCAGCAATTGGCACAGGTCCCTGGCTGTCATGTCTG

CTAGAATCTCCACCACTTTGCTCGTCCCATCTTCACTAAAGACTTTAACATCCTGCTTTGCGGCGGCCTGGCTCG

GAGGTAAAGAACCCGGCGTGAGCACAGGGGGGCTCCCAGGGCCACAGAGTTCAGGAAAAGGATTCGGGATGGCCG

GCAGAGACGAGGTTCTAAATTGCTGGTCTTCCTCCTGAAGGCGCCTGACAGCAAGTATGTGCACAGGCTGGGAGC

GCTGCACCCTCTGCCTCGGGGACACCTGTGGCTGGACGGACCGAGGGCCTGAAGCCCGAGGTTGGCTGCGGTCAT

GCTGGCCATTCTGCAGGAGGGGCACTGTGTCTGACTGCATGCTGCAGGCTGAGTACAGGCTATCCAGGGATGCGT

TCATATCGTTCACCAGGGCTTCCAGGTCCACATCATCCTCCTGGTGATGTGTGAGTCGGTCAGACTGTGCGGGGA

-continued

GTCCTGGTCCTGCCGGGTCTTGTTGACTGCGAGGTGTCTGCTCCACCTTGTCCTGGTAGTACGGATGGTGCAAAA

AGGAATCTGGGCAGCCAGCTAAAGCCATGGGTTCCTTCTGCCTTCTTCAAAT

>XM_017337635.1 PREDICTED: *Oryctolagus cuniculus* growth factor receptor bound protein 10 (GRB10), mRNA

SEQ ID NO: 27

GCGGCGGCGGCGGCGGCGCGGGGCGCCCGGCACCGTCCTGTGCGCAGCCTCGCCCGCGGGGACCCGCGACCGCCG

CCGGCCACGCCGAGGGTCGCAGGCGGCCACGCGGAGGGAGGAGCGGCGCCTCGGCAGACCTGCGGGAACCAGCTC

AGAGACCCCAGCGGAGACGGCCGTGTAGCTGACGAGGCCAGCATGGAGCGCATGAGAGGACGCAGGAAGGATGAC

GACCTGGAGAAGCTGGTGAATGACATGAACACATCCTTGGAGAGCCTGTACTCGGCCTGCAGCAACATGCAGTCG

GACACGGTGCCCCTGCTGCAGAACGGCCAGCACACCCGCAGCCCGCCGCCTGCCGCGAGTGCCCGCCCCGCCCCG

CCGCAGAAGGTGCAGCGCTCCCAGCCTGTGCACATCCTGGCCGTCAGCAGGCGCCTTCAGGATGAAGACCCGCAG

TTCCGAACCTCTTCGCTGCCGGCCATCCCCAACCCCTTCCCAGAGCTCAGCGGCCCTGGGAGCTCCCCGGTGCTC

CCGCCGGCCTCCCTGCCTCCGAGCCAGCCCGTGACAAAGCAGGATGTCAAGGTCTTTAGTGAGGATGGGACAAGC

AAAGTGGTGGAGATTCTGACGGACATGACAGCCCGGGACCTGTGCCAGCTGCTGATTTACAGGAGTCACTGCGTG

GATGACAACAGCTGGACCCTGGTGGAACACCACCCACACCTGGGACTCGAGCGGTGCTTGGAAGACCATGAGCTG

GTGGTGCAGGTGGAGGGCACCATGGGAAGTGAGGGCAAATTTCTGTTCAGGAAGAATTATGCGAAATACGAGTTC

TTCAGAAACCCTGTGAATTTCTTCCCGGAACAAATGGTCACTTGGTGCCAGCAGTCCAATGGAAGTCATACGCAG

CTGCTGCAGAACTTCCTGAACGCCAGCAGCTGCCCTGAGATTCAAGGATTTCTGCACGTGAAGGAGCTGGGAAGA

AAGTCGTGGAAGAGGCTGTATGTGTGCCTGCGCCGGTCTGGCCTCTACTGCTCCACTAAGGGAACATCCAAAGAA

CCCAGGCACCTGCAGCTGCTTGCTGACCTGGAGGAGAGCAACATCTTCTCCCTGATTTCTGGGAAGAAGCAGTAC

AGTGCACCCACGGACCACGGGCTCTGCATAAAGCCAAACAAAGTGAGGAATGAAATCAAGGAACTGCGACTGCTG

TGTGCAGAGGATGAGCAAAGCCGCATATGCTGGATGACTGCGTTCCGTCTCCTTAAGTATGGAATGCTCCTGTAC

CAGAACTATCGCATCCCTCAGCAGAGGAAGGCCTTGCTGGCACCCTTTGCAACACCAGTGCGCAGTGTCTCTGAG

AACTCTCTTGTGGCAATGGATTTTTCTGGGCAAACAGGAAGAGTCATTGAGAATCCAGCTGAAGCCCAGAGTGCT

GCCCTGGAGGAGGGCCATGCCTGGAGGAAGAGAAGCACTCGGATGAACATCTTATCTAGCCAAAGTCCCCTCCAC

CCTAACTCCTTCAGCACCGTGATCCACAGGACCCAGCACTGGTTCCATGGGAGGATCTCCAGGGAGGAGTCCCAC

AGGATCATCAAGCAGCAAGGGCTTGTGGATGGGCTTTTCCTGCTTCGTGACAGCCAGAGTAACCCAAAGGCATTT

GTACTCACACTGTGTCATCACCAGAAAATTAAAAACTTCCAGATCTTACCTTGTGAGGATGATGGGCAGACCTTC

CTCAGCCTGGATGACGGCAACACCAGGTTCTCCGACCTGATCCAGCTGGTTGACTTCTACCAGCTGAACAAAGGG

GTCCTGCCTTGCAAACTCAAGCACCACTGCATCCGAGTGGCCTTATGACCTCCCACCTGGAGGCCGTTCACACTG

GAACGAGGAAGAGGTCTGCGCGTGTATTGAGAATATTTCTGTACCATCAGATGGTTCCTCCGGTACCAGCCAACC

AGGAGGGACTTGTTTGTTGAATTGACATTTTCCTGCCGCACACCTGGCGGGACCATGGCCCTTTGTTATCATCCA

AATCAGAAAGGGCCTGAGAAATCCAGCGCAAGTTGGAAAAATAAACTGGAAAGATCATCTTGGCTGGGCCACATC

AGAACAAGAACCGGAGAGAAGGAATTGGAAACGAACTCTTGCCCTGGAGTAATCTTGACAATTAAAACTGATATG

TTTACTTTTTTTGTATTGATCACTTTTTTGCACTCCTTCTGTGTTGTCAGTGTTGTATTCAGCCTCTGGCAGGAG

GGACGTGGCTGGTCAGCCTTTGTGTAGGAGGGACGTAGCTGGTCAGCCTGTGTCAGATGAGCAGAGTTGCGAGTG

GGGGTGGGCGTCAGACTGACCGTGGGTGCCCCAGTGTTCCCATAGGTAGCTACGCCCTCTCTAGATTGCCACAAC

ATGGATTCAGCTCCCAGATTACAAACACCCCCTGCCCCTACCCCAGCCCTTCCCAGTATACTTGAAAAGCTTTGT

TTTTAAATATACAAGGTGTCACCTGTGGTAGGCGTTTGGCATGTTTCGTGGACTGGTCTGTCATTAGCCATTGCT

CTGTGCACAGGTGTCCCGTCCTGTTGTTGTCAGCGTGTCTCATTCTCCACGTGCCGTGGACTCTGTTTCTTTGGA

AAACTCACTGTGCCCCAGCACAGCAGGGCTGGGCGATGCCCTCCAGCTTAGCACAGGCTGGCCTTCTCGGGATGC

GCCCAGCCTGTTGCGCAGTCCGTCTGGGGAAATCTCAGCCTCGCATTTTCCCAGCCACCAGCCTGTTCTAGAACA

-continued

GTCACTGCCTTACCCCCTTGCGGTGGTGTGAGTCGTCCTGTGGCTGATCCCCCTTAGGAGGTTAAAGAAGCTGCA
GAGAAAATGGCACCAGGTAGCTTTCTGCTGTGCTCCGTGGGTTTCCATGGCGGTGAAGACAGAGCCGTTGCAGAG
GGCACAGGCTTGGGCTGGCTTTCCAAGGTCAGTGGCCTCTGTCCTGTGAGCCTGTGGACGTGGGCAGTAATGCCT
CAGTGGCTGTGGGTGCTGGCCAGTGGTAGCAACAACTCACTTGCTTCCCACTCTGGGAGATGAGTCAGTCAGAGG
CTCAAGTTGTCACTGGGTCCGCTCCTCCCCTGGCCTTGTCTTAAAGTGTGAGAGGGGCTATTTCTGTACCTTTGA
CTGCCACAGAGCAGAAGGGACAGCCCTGACAAGCCCCCACACCACTGGGGTGAATAGAGTGACTACCTTGCCCAA
GGTGACACCTGACCGGCTCTGCTGAGCCCGTGCTAGCCACTGGCTCACCCCAGCTCCCTTCCACAGCACGTCCTG
GACCTCTGGTTGATGTGTGTGGGTGAGCACAGACATGGGAGAGCTGTGCTGAGACAGGCTGGCTGCCGCCCGTCC
ATGGTATGGAAACGCTGGACTGTAGTTCCCAGAGCACGCTCCTGTTGTTTCCATGAAATGCCTACTCACTGAAAT
GAAGACTTTTGTAGCAAAGTGTTATTTTTAACCATAAATGCTCAGTGGCCTCTTCTTCCTTTTGCACCCAGTTAA
TCTTTGGAACAATTGACAACGGGGTGATTGTCAAGTTAGTGGCTGGCGGCTGCTGCCGCTGACCCCACTCTGGGA
GGGCTGTCTCGTTCCCCACCAGACCCTTCTTTCCCTCACTGACCCCACCCTGGGGAGAGCTGTCTCCATCCCCAC
CAGCTGGCAAAACCTTTACAGACAACTCTAGGGTTTCTTTGCTCTGTTTCTGTAGACAACGCAACAGCGCCAAAC
CCCTCCCTCATGCCGCTCCCTGACGGACAGCTAGGATGTGCAGTATTTCATATTTATAAGTGTGCGTTCTATTTA
AAAGAAGAACAAAGCTTGGCTCTGACTCACGATTTTGTATGTAGCTGGTTTGACGTAGTCTTTTGTACCTCCCCA
GCGTAGTGAATTGTGGAGAGTGTAGACCGCCCTGCCCGCGTGCAGCAGACTTCTCGCGGCCCCTGGCTGGGAATC
CCACCTGGAAACAGCAAGTCCCTTGTGCCTGTGGTGGCATATGCCCCCGGGCTGGGACGGAAGGACATTTGACTT
TTATTTTTGTATTTAATTGACGTGAATGTAAAGGGGACAGCTCAGGGTTGTTGTGGAGCCTGTTGACCTTTTTCT
CTGCCTGTGATTTTATTTTCTGAATGGAAACTCCATTGTAGCAACCTGGATTAAGTCGAGAAGGAAAACGCCAAA
TGCTTTGGGTGTTGTTAGAGTTCCAGAATCTTCTTTTTGTTTGCTAAACCTTGAAGAAACATGTGCCTCAGCTTA
GGTGTTTTGTCCTCTCCTTTCTGCACTTGACACCTGACAGTCTGACCCATCGCTGCGCCTTGCGGGCTGGGACTA
GCTCCTTATAGATTTGTGATGTGGCAGTGTCACCCTGTGTGTCATCAGTTCAGGGACTGCAGAAGGTGTTGATGA
GGAGACAAAACCTTTACCCGCGTGCTCCGCTTCATTCTGTACATAGCTCTCTGGCTCGTGAACCTAACTGTAAAC
GTTCAGGTATTTTTGTACAAATAAGGGACTGATGTTCTGTTTCTTGTAACTAGAAATAAACATTAATACAGTGTT
CTTCATTTTC

>Reverse Complement of SEQ ID NO: 27

SEQ ID NO: 28

GAAAATGAAGAACACTGTATTAATGTTTATTTCTAGTTACAAGAAACAGAACATCAGTCCCTTATTTGTACAAAA
ATACCTGAACGTTTACAGTTAGGTTCACGAGCCAGAGAGCTATGTACAGAATGAAGCGGAGCACGCGGGTAAAGG
TTTTGTCTCCTCATCAACACCTTCTGCAGTCCCTGAACTGATGACACACAGGGTGACACTGCCACATCACAAATC
TATAAGGAGCTAGTCCCAGCCCGCAAGGCGCAGCGATGGGTCAGACTGTCAGGTGTCAAGTGCAGAAAGGAGAGG
ACAAAACACCTAAGCTGAGGCACATGTTTCTTCAAGGTTTAGCAAACAAAAAGAAGATTCTGGAACTCTAACAAC
ACCCAAAGCATTTGGCGTTTTCCTTCTCGACTTAATCCAGGTTGCTACAATGGAGTTTCCATTCAGAAAATAAAA
TCACAGGCAGAGAAAAAGGTCAACAGGCTCCACAACAACCCTGAGCTGTCCCCTTTACATTCACGTCAATTAAAT
ACAAAAATAAAAGTCAAATGTCCTTCCGTCCCAGCCCGGGGGCATATGCCACCACAGGCACAAGGGACTTGCTGT
TTCCAGGTGGGATTCCCAGCCAGGGGCCGCGAGAAGTCTGCTGCACGCGGGCAGGGCGGTCTACACTCTCCACAA
TTCACTACGCTGGGGAGGTACAAAAGACTACGTCAAACCAGCTACATACAAAATCGTGAGTCAGAGCCAAGCTTT
GTTCTTCTTTTAAATAGAACGCACACTTATAAATATGAAATACTGCACATCCTAGCTGTCCGTCAGGGAGCGGCA
TGAGGGAGGGGTTTGGCGCTGTTGCGTTGTCTACAGAAACAGAGCAAAGAAACCCTAGAGTTGTCTGTAAAGGTT
TTGCCAGCTGGTGGGGATGGAGACAGCTCTCCCCAGGGTGGGGTCAGTGAGGGAAAGAAGGGTCTGGTGGGGAAC
GAGACAGCCCTCCCAGAGTGGGGTCAGCGGCAGCAGCCGCCAGCCACTAACTTGACAATCACCCCGTTGTCAATT

-continued
GTTCCAAAGATTAACTGGGTGCAAAAGGAAGAAGAGGCCACTGAGCATTTATGGTTAAAAATAACACTTTGCTAC
AAAAGTCTTCATTTCAGTGAGTAGGCATTTCATGGAAACAACAGGAGCGTGCTCTGGGAACTACAGTCCAGCGTT
TCCATACCATGGACGGGCGGCAGCCAGCCTGTCTCAGCACAGCTCTCCCATGTCTGTGCTCACCCACACACATCA
ACCAGAGGTCCAGGACGTGCTGTGGAAGGGAGCTGGGGTGAGCCAGTGGCTAGCACGGGCTCAGCAGAGCCGGTC
AGGTGTCACCTTGGGCAAGGTAGTCACTCTATTCACCCCAGTGGTGTGGGGGCTTGTCAGGGCTGTCCCTTCTGC
TCTGTGGCAGTCAAAGGTACAGAAATAGCCCCTCTCACACTTTAAGACAAGGCCAGGGGAGGAGCGGACCCAGTG
ACAACTTGAGCCTCTGACTGACTCATCTCCCAGAGTGGGAAGCAAGTGAGTTGTTGCTACCACTGGCCAGCACCC
ACAGCCACTGAGGCATTACTGCCCACGTCCACAGGCTCACAGGACAGAGGCCACTGACCTTGGAAAGCCAGCCCA
AGCCTGTGCCCTCTGCAACGGCTCTGTCTTCACCGCCATGGAAACCCACGGAGCACAGCAGAAAGCTACCTGGTG
CCATTTTCTCTGCAGCTTCTTTAACCTCCTAAGGGGGATCAGCCACAGGACGACTCACACCACCGCAAGGGGGTA
AGGCAGTGACTGTTCTAGAACAGGCTGGTGGCTGGGAAAATGCGAGGCTGAGATTTCCCCAGACGGACTGCGCAA
CAGGCTGGGCGCATCCCGAGAAGGCCAGCCTGTGCTAAGCTGGAGGGCATCGCCCAGCCCTGCTGTGCTGGGGCA
CAGTGAGTTTTCCAAAGAAACAGAGTCCACGGCACGTGGAGAATGAGACACGCTGACAACAACAGGACGGGACAC
CTGTGCACAGAGCAATGGCTAATGACAGACCAGTCCACGAAACATGCCAAACGCCTACCACAGGTGACACCTTGT
ATATTTAAAAACAAAGCTTTTCAAGTATACTGGGAAGGGCTGGGGTAGGGGCAGGGGGTGTTTGTAATCTGGGAG
CTGAATCCATGTTGTGGCAATCTAGAGAGGGCGTAGCTACCTATGGGAACACTGGGGCACCCACGGTCAGTCTGA
CGCCCACCCCCACTCGCAACTCTGCTCATCTGACACAGGCTGACCAGCTACGTCCCTCCTACACAAAGGCTGACC
AGCCACGTCCCTCCTGCCAGAGGCTGAATACAACACTGACAACACAGAAGGAGTGCAAAAAAGTGATCAATACAA
AAAAAGTAAACATATCAGTTTTAATTGTCAAGATTACTCCAGGGCAAGAGTTCGTTTCCAATTCCTTCTCTCCGG
TTCTTGTTCTGATGTGGCCCAGCCAAGATGATCTTTCCAGTTTATTTTTCCAACTTGCGCTGGATTTCTCAGGCC
CTTTCTGATTTGGATGATAACAAAGGGCCATGGTCCCGCCAGGTGTGCGGCAGGAAAATGTCAATTCAACAAACA
AGTCCCTCCTGGTTGGCTGGTACCGGAGGAACCATCTGATGGTACAGAAATATTCTCAATACACGCGCAGACCTC
TTCCTCGTTCCAGTGTGAACGGCCTCCAGGTGGGAGGTCATAAGGCCACTCGGATGCAGTGGTGCTTGAGTTTGC
AAGGCAGGACCCCTTTGTTCAGCTGGTAGAAGTCAACCAGCTGGATCAGGTCGGAGAACCTGGTGTTGCCGTCAT
CCAGGCTGAGGAAGGTCTGCCCATCATCCTCACAAGGTAAGATCTGGAAGTTTTTAATTTTCTGGTGATGACACA
GTGTGAGTACAAATGCCTTTGGGTTACTCTGGCTGTCACGAAGCAGGAAAAGCCCATCCACAAGCCCTTGCTGCT
TGATGATCCTGTGGGACTCCTCCCTGGAGATCCTCCCATGGAACCAGTGCTGGGTCCTGTGGATCACGGTGCTGA
AGGAGTTAGGGTGGAGGGGACTTTGGCTAGATAAGATGTTCATCCGAGTGCTTCTCTTCCTCCAGGCATGGCCCT
CCTCCAGGGCAGCACTCTGGGCTTCAGCTGGATTCTCAATGACTCTTCCTGTTTGCCCAGAAAAATCCATTGCCA
CAAGAGAGTTCTCAGAGACACTGCGCACTGGTGTTGCAAAGGGTGCCAGCAAGGCCTTCCTCTGCTGAGGGATGC
GATAGTTCTGGTACAGGAGCATTCCATACTTAAGGAGACGGAACGCAGTCATCCAGCATATGCGGCTTTGCTCAT
CCTCTGCACACAGCAGTCGCAGTTCCTTGATTTCATTCCTCACTTTGTTTGGCTTTATGCAGAGCCCGTGGTCCG
TGGGTGCACTGTACTGCTTCTTCCCAGAAATCAGGGAGAAGATGTTGCTCTCCTCCAGGTCAGCAAGCAGCTGCA
GGTGCCTGGGTTCTTTGGATGTTCCCTTAGTGGAGCAGTAGAGGCCAGACCGGCGCAGGCACACATACAGCCTCT
TCCACGACTTTCTTCCCAGCTCCTTCACGTGCAGAAATCCTTGAATCTCAGGGCAGCTGCTGGCGTTCAGGAAGT
TCTGCAGCAGCTGCGTATGACTTCCATTGGACTGCTGGCACCAAGTGACCATTTGTTCCGGGAAGAAATTCACAG
GGTTTCTGAAGAACTCGTATTTCGCATAATTCTTCCTGAACAGAAATTTGCCCTCACTTCCCATGGTGCCCTCCA
CCTGCACCACCAGCTCATGGTCTTCCAAGCACCGCTCGAGTCCCAGGTGTGGGTGGTGTTCCACCAGGGTCCAGC
TGTTGTCATCCACGCAGTGACTCCTGTAAATCAGCAGCTGGCACAGGTCCCGGGCTGTCATGTCCGTCAGAATCT
CCACCACTTTGCTTGTCCCATCCTCACTAAAGACCTTGACATCCTGCTTTGTCACGGGCTGGCTCGGAGGCAGGG
AGGCCGGCGGGAGCACCGGGGAGCTCCCAGGGCCGCTGAGCTCTGGGAAGGGGTTGGGGATGGCCGGCAGCGAAG -continued

AGGTTCGGAACTGCGGGTCTTCATCCTGAAGGCGCCTGCTGACGGCCAGGATGTGCACAGGCTGGGAGCGCTGCA

CCTTCTGCGGCGGGGCGGGGCGGGCACTCGCGGCAGGCGGCGGGCTGCGGGTGTGCTGGCCGTTCTGCAGCAGGG

GCACCGTGTCCGACTGCATGTTGCTGCAGGCCGAGTACAGGCTCTCCAAGGATGTGTTCATGTCATTCACCAGCT

TCTCCAGGTCGTCATCCTTCCTGCGTCCTCTCATGCGCTCCATGCTGGCCTCGTCAGCTACACGGCCGTCTCCGC

TGGGGTCTCTGAGCTGGTTCCCGCAGGTCTGCCGAGGCGCCGCTCCTCCCTCCGCGTGGCCGCCTGCGACCCTCG

GCGTGGCCGGCGGCGGTCGCGGGTCCCCGCGGGCGAGGCTGCGCACAGGACGGTGCCGGGCGCCCCGCGCCGCCG

CCGCCGCCGC

>NM_004490.3 *Homo sapiens* growth factor receptor bound protein 14 (GRB14), transcript variant 1, mRNA

SEQ ID NO: 29

GCAGATAGCTCGGCCGCGCGTCTCAGCCGCCGGGGCCCCGAGCGCAGGCGGCGAGGCCACCACACCTGCAGAGCG

CTCGGGCTGCCTAGCCGGCACCTCGCCTCCCGCCGCGCAAACCCCTTCTCCCCACGCGCCGAGTCTCCCATGACG

CCCGAGCCCCCCGGCCGGCGACAATGACCACTTCCCTGCAAGATGGGCAGAGCGCCGCGAGCAGGGCGGCTGCCC

GGGATTCGCCGCTGGCCGCCCAGGTGTGTGGCGCTGCCCAGGGGAGGGGCGACGCCCACGACCTGGCGCCGGCCC

CCTGGCTGCACGCGCGAGCGCTCCTGCCCCTTCCGGACGGGACCCGCGGCTGTGCTGCAGACAGGAGAAAAAAGA

AAGATCTTGATGTTCCGGAAATGCCATCTATTCCAAACCCTTTTCCTGAGCTATGCTGTTCTCCATTTACATCTG

TGTTGTCAGCAGACCTATTTCCCAAAGCAAATTCAAGGAAAAAACAGGTGATTAAAGTATACAGTGAAGATGAAA

CCAGCAGGGCTTTAGATGTACCCAGTGACATAACGGCTCGAGATGTTTGTCAGCTGTTGATCCTGAAGAATCATT

ACATTGATGACCACAGCTGGACCCTTTTTGAGCACCTGCCTCACATAGGTGTAGAAAGAACAATAGAAGACCACG

AACTGGTGATTGAAGTGCTATCCAACTGGGGGATAGAAGAAGAAAACAAACTATACTTTAGAAAAAATTATGCCA

AATATGAGTTCTTTAAAAACCCAATGTATTTTTTTCCAGAGCATATGGTATCTTTTGCAACTGAAACCAATGGTG

AAATATCCCCCACACAGATTTTGCAGATGTTTCTGAGTTCAAGCACATATCCTGAAATTCATGGTTTCTTACATG

CGAAAGAACAGGGAAAGAAGTCTTGGAAAAAAATTTACTTTTTTCTAAGAAGATCTGGTTTATATTTTTCTACTA

AAGGAACATCAAAGGAACCGCGGCATTTGCAGTTTTTCAGCGAATTTGGCAATAGTGATATTTATGTGTCACTGG

CAGGCAAAAAAAAACATGGAGCACCGACTAACTATGGATTCTGCTTTAAGCCTAACAAAGCGGGAGGGCCCCGAG

ACCTGAAAATGCTCTGTGCAGAAGAAGAGCAGAGTAGGACGTGCTGGGTGACCGCGATTAGATTGCTTAAGTATG

GCATGCAGCTGTACCAGAATTATATGCATCCATATCAAGGTAGAAGTGGCTGCAGTTCACAGAGCATATCACCTA

TGAGAAGTATATCAGAGAATTCCCTGGTAGCAATGGACTTCTCAGGCCAGAAAAGCAGAGTTATAGAAAATCCCA

CTGAAGCCCTTTCAGTTGCGGTTGAAGAAGGACTCGCTTGGAGGAAAAAAGGATGTTTACGCCTGGGCACTCACG

GTAGCCCCACTGCCTCTTCACAGAGCTCTGCCACAAACATGGCTATCCACCGGTCCCAGCCATGGTTTCACCACA

AAATTTCTAGAGATGAGGCTCAGCGATTGATTATTCAGCAAGGACTTGTGGATGGAGTTTTCTTGGTACGGGATA

GTCAGAGTAACCCCAAAACTTTCGTACTGTCAATGAGTCATGGACAAAAAATAAAGCACTTTCAAATTATACCAG

TAGAAGATGACGGTGAAATGTTCCACACACTGGATGATGGCCACACAAGATTTACAGATCTAATACAGCTGGTGG

AGTTCTATCAACTCAATAAGGGCGTTCTTCCTTGCAAGTTGAAACATTATTGTGCTAGGATTGCTCTCTAGACAA

GCCAGAAGTGACTTATTAAACTATTGAAGGAAAAGGACTCAAGAAAAATAATAAAAGACCATAAATAAGGGCGAA

AACATTACCATGTGAAAAGAATGTATTTCACCTGCAAGTTACAAAAAAATAGTTTGTGCATTGCAAATAAGCAAA

GACTTGGATTGACTTTACATTCATCATTTAAAATTCATTAGTTAAAATTAAACCTTAGGAAAAAAATGACTTGGT

GTGTTCTTGTGTGATTTTTACATTGCTATAATATTTTCTTCAAATATGCATATTTAAAACATGTCTCCCTTATTT

ACCATATAGCAACATCAGAATTCTGAAACACAAAATATGAAATAAATTGGGAGTCAGGAATAATTATTTGTGCAC

TAAATTTCAATTATACTATTTTTTAATGTTAAGAAATATGATAATAACTTATCAATTAAAAGAAACTATCCACAA

-continued

CCTGTTAATGAAACTAAAAACTATTTTGAATTATATATTTTCCGGGTTTATGATCATCTTAAAATGAAATCATAT

TTTGAGATAGTAGCTTTAAACCATTTTGAAATATGTTGATTTTTTCCAGGTAATTTAAAAATATTATTAAATAGT

TAATTATAAAATTTA

>Reverse Complement of SEQ ID NO: 29

SEQ ID NO: 30

TAAATTTTATAATTAACTATTTAATAATATTTTTAAATTACCTGGAAAAAATCAACATATTTCAAAATGGTTTAA

AGCTACTATCTCAAAATATGATTTCATTTTAAGATGATCATAAACCCGGAAAATATATAATTCAAAATAGTTTTT

AGTTTCATTAACAGGTTGTGGATAGTTTCTTTTAATTGATAAGTTATTATCATATTTCTTAACATTAAAAAATAG

TATAATTGAAATTTAGTGCACAAATAATTATTCCTGACTCCCAATTTATTTCATATTTTGTGTTTCAGAATTCTG

ATGTTGCTATATGGTAAATAAGGGAGACATGTTTTAAATATGCATATTTGAAGAAAATATTATAGCAATGTAAAA

ATCACACAAGAACACACCAAGTCATTTTTTTCCTAAGGTTTAATTTTAACTAATGAATTTTAAATGATGAATGTA

AAGTCAATCCAAGTCTTTGCTTATTTGCAATGCACAAACTATTTTTTTGTAACTTGCAGGTGAAATACATTCTTT

TCACATGGTAATGTTTTCGCCCTTATTTATGGTCTTTTATTATTTTTCTTGAGTCCTTTTCCTTCAATAGTTTAA

TAAGTCACTTCTGGCTTGTCTAGAGAGCAATCCTAGCACAATAATGTTTCAACTTGCAAGGAAGAACGCCCTTAT

TGAGTTGATAGAACTCCACCAGCTGTATTAGATCTGTAAATCTTGTGTGGCCATCATCCAGTGTGTGGAACATTT

CACCGTCATCTTCTACTGGTATAATTTGAAAGTGCTTTATTTTTTGTCCATGACTCATTGACAGTACGAAAGTTT

TGGGGTTACTCTGACTATCCCGTACCAAGAAAACTCCATCCACAAGTCCTTGCTGAATAATCAATCGCTGAGCCT

CATCTCTAGAAATTTTGTGGTGAAACCATGGCTGGGACCGGTGGATAGCCATGTTTGTGGCAGAGCTCTGTGAAG

AGGCAGTGGGGCTACCGTGAGTGCCCAGGCGTAAACATCCTTTTTTCCTCCAAGCGAGTCCTTCTTCAACCGCAA

CTGAAAGGGCTTCAGTGGGATTTTCTATAACTCTGCTTTTCTGGCCTGAGAAGTCCATTGCTACCAGGGAATTCT

CTGATATACTTCTCATAGGTGATATGCTCTGTGAACTGCAGCCACTTCTACCTTGATATGGATGCATATAATTCT

GGTACAGCTGCATGCCATACTTAAGCAATCTAATCGCGGTCACCCAGCACGTCCTACTCTGCTCTTCTTCTGCAC

AGAGCATTTTCAGGTCTCGGGGCCCTCCCGCTTTGTTAGGCTTAAAGCAGAATCCATAGTTAGTCGGTGCTCCAT

GTTTTTTTTTGCCTGCCAGTGACACATAAATATCACTATTGCCAAATTCGCTGAAAAACTGCAAATGCCGCGGTT

CCTTTGATGTTCCTTTAGTAGAAAAATATAAACCAGATCTTCTTAGAAAAAAGTAAATTTTTTTCCAAGACTTCT

TTCCCTGTTCTTTCGCATGTAAGAAACCATGAATTTCAGGATATGTGCTTGAACTCAGAAACATCTGCAAAATCT

GTGTGGGGGATATTTCACCATTGGTTTCAGTTGCAAAAGATACCATATGCTCTGGAAAAAAATACATTGGGTTTT

TAAAGAACTCATATTTGGCATAATTTTTTCTAAAGTATAGTTTGTTTTCTTCTTCTATCCCCCAGTTGGATAGCA

CTTCAATCACCAGTTCGTGGTCTTCTATTGTTCTTTCTACACCTATGTGAGGCAGGTGCTCAAAAAGGGTCCAGC

TGTGGTCATCAATGTAATGATTCTTCAGGATCAACAGCTGACAAACATCTCGAGCCGTTATGTCACTGGGTACAT

CTAAAGCCCTGCTGGTTTCATCTTCACTGTATACTTTAATCACCTGTTTTTTCCTTGAATTTGCTTTGGGAAATA

GGTCTGCTGACAACACAGATGTAAATGGAGAACAGCATAGCTCAGGAAAAGGGTTTGGAATAGATGGCATTTCCG

GAACATCAAGATCTTTCTTTTTTCTCCTGTCTGCAGCACAGCCGCGGGTCCCGTCCGGAAGGGGCAGGAGCGCTC

GCGCGTGCAGCCAGGGGGCCGGCGCCAGGTCGTGGGCGTCGCCCCTCCCCTGGGCAGCGCCACACACCTGGGCGG

CCAGCGGCGAATCCCGGGCAGCCGCCCTGCTCGCGGCGCTCTGCCCATCTTGCAGGGAAGTGGTCATTGTCGCCG

GCCGGGGGGCTCGGGCGTCATGGGAGACTCGGCGCGTGGGGAGAAGGGGTTTGCGCGGCGGGAGGCGAGGTGCCG

GCTAGGCAGCCCGAGCGCTCTGCAGGTGTGGTGGCCTCGCCGCCTGCGCTCGGGGCCCCGGCGGCTGAGACGCGC

GGCCGAGCTATCTGC

>NM_001303422.2 *Homo sapiens* growth factor receptor bound protein 14 (GRB14), transcript variant 2, mRNA

SEQ ID NO: 31

ATTACTTTCCTAGTTGTTTCATTGCACTGAGCCCTGAGATTCCCAAGGAGTAACCATAAAAGATTTCTTTTATTT

TGTCCATGACCTACGAGACAGGATCATTCTAAGAAGAGCAGGCATGAGTTTGAGTGCAAGAAGAGTCACTCTGCC

-continued

TGCAATAACGCCAATAATTCTACAGAAAAGGGTGATTAAAGTATACAGTGAAGATGAAACCAGCAGGGCTTTAGA

TGTACCCAGTGACATAACGGCTCGAGATGTTTGTCAGCTGTTGATCCTGAAGAATCATTACATTGATGACCACAG

CTGGACCCTTTTTGAGCACCTGCCTCACATAGGTGTAGAAAGAACAATAGAAGACCACGAACTGGTGATTGAAGT

GCTATCCAACTGGGGGATAGAAGAAGAAAACAAACTATACTTTAGAAAAAATTATGCCAAATATGAGTTCTTTAA

AAACCCAATGTATTTTTTTCCAGAGCATATGGTATCTTTTGCAACTGAAACCAATGGTGAAATATCCCCCACACA

GATTTTGCAGATGTTTCTGAGTTCAAGCACATATCCTGAAATTCATGGTTTCTTACATGCGAAAGAACAGGGAAA

GAAGTCTTGGAAAAAAATTTACTTTTTTCTAAGAAGATCTGGTTTATATTTTTCTACTAAAGGAACATCAAAGGA

ACCGCGGCATTTGCAGTTTTTCAGCGAATTTGGCAATAGTGATATTTATGTGTCACTGGCAGGCAAAAAAAAACA

TGGAGCACCGACTAACTATGGATTCTGCTTTAAGCCTAACAAAGCGGGAGGGCCCCGAGACCTGAAAATGCTCTG

TGCAGAAGAAGAGCAGAGTAGGACGTGCTGGGTGACCGCGATTAGATTGCTTAAGTATGGCATGCAGCTGTACCA

GAATTATATGCATCCATATCAAGGTAGAAGTGGCTGCAGTTCACAGAGCATATCACCTATGAGAAGTATATCAGA

GAATTCCCTGGTAGCAATGGACTTCTCAGGCCAGAAAAGCAGAGTTATAGAAAATCCCACTGAAGCCCTTTCAGT

TGCGGTTGAAGAAGGACTCGCTTGGAGGAAAAAAGGATGTTTACGCCTGGGCACTCACGGTAGCCCCACTGCCTC

TTCACAGAGCTCTGCCACAAACATGGCTATCCACCGGTCCCAGCCATGGTTTCACCACAAAATTTCTAGAGATGA

GGCTCAGCGATTGATTATTCAGCAAGGACTTGTGGATGGAGTTTTCTTGGTACGGGATAGTCAGAGTAACCCCAA

AACTTTCGTACTGTCAATGAGTCATGGACAAAAAATAAAGCACTTTCAAATTATACCAGTAGAAGATGACGGTGA

AATGTTCCACACACTGGATGATGGCCACACAAGATTTACAGATCTAATACAGCTGGTGGAGTTCTATCAACTCAA

TAAGGGCGTTCTTCCTTGCAAGTTGAAACATTATTGTGCTAGGATTGCTCTCTAGACAAGCCAGAAGTGACTTAT

TAAACTATTGAAGGAAAAGGACTCAAGAAAAATAATAAAAGACCATAAATAAGGGCGAAAACATTACCATGTGAA

AAGAATGTATTTCACCTGCAAGTTACAAAAAAATAGTTTGTGCATTGCAAATAAGCAAAGACTTGGATTGACTTT

ACATTCATCATTTAAAATTCATTAGTTAAAATTAAACCTTAGGAAAAAAATGACTTGGTGTGTTCTTGTGTGATT

TTTACATTGCTATAATATTTTCTTCAAATATGCATATTTAAAACATGTCTCCCTTATTTACCATATAGCAACATC

AGAATTCTGAAACACAAAATATGAAATAAATTGGGAGTCAGGAATAATTATTTGTGCACTAAATTTCAATTATAC

TATTTTTTAATGTTAAGAAATATGATAATAACTTATCAATTAAAAGAAACTATCCACAACCTGTTAATGAAACTA

AAAACTATTTTGAATTATATATTTTCCGGGTTTATGATCATCTTAAAATGAAATCATATTTTGAGATAGTAGCTT

TAAACCATTTTGAAATATGTTGATTTTTTCCAGGTAATTTAAAAATATTATTAAATAGTTAATTATAAAATTTA

>Reverse Complement of SEQ ID NO: 31

SEQ ID NO: 32

TAAATTTTATAATTAACTATTTAATAATATTTTTAAATTACCTGGAAAAAATCAACATATTTCAAAATGGTTTAA

AGCTACTATCTCAAAATATGATTTCATTTTAAGATGATCATAAACCCGGAAAATATATAATTCAAAATAGTTTTT

AGTTTCATTAACAGGTTGTGGATAGTTTCTTTTAATTGATAAGTTATTATCATATTTCTTAACATTAAAAAATAG

TATAATTGAAATTTAGTGCACAAATAATTATTCCTGACTCCCAATTTATTTCATATTTTGTGTTTCAGAATTCTG

ATGTTGCTATATGGTAAATAAGGGAGACATGTTTTAAATATGCATATTTGAAGAAAATATTATAGCAATGTAAAA

ATCACACAAGAACACACCAAGTCATTTTTTTCCTAAGGTTTAATTTTAACTAATGAATTTTAAATGATGAATGTA

AAGTCAATCCAAGTCTTTGCTTATTTGCAATGCACAAACTATTTTTTTGTAACTTGCAGGTGAAATACATTCTTT

TCACATGGTAATGTTTTCGCCCTTATTTATGGTCTTTTATTATTTTTCTTGAGTCCTTTTCCTTCAATAGTTTAA

TAAGTCACTTCTGGCTTGTCTAGAGAGCAATCCTAGCACAATAATGTTTCAACTTGCAAGGAAGAACGCCCTTAT

TGAGTTGATAGAACTCCACCAGCTGTATTAGATCTGTAAATCTTGTGTGGCCATCATCCAGTGTGTGGAACATTT

CACCGTCATCTTCTACTGGTATAATTTGAAAGTGCTTTATTTTTTGTCCATGACTCATTGACAGTACGAAAGTTT

TGGGGTTACTCTGACTATCCCGTACCAAGAAAACTCCATCCACAAGTCCTTGCTGAATAATCAATCGCTGAGCCT

CATCTCTAGAAATTTTGTGGTGAAACCATGGCTGGGACCGGTGGATAGCCATGTTTGTGGCAGAGCTCTGTGAAG

AGGCAGTGGGGCTACCGTGAGTGCCCAGGCGTAAACATCCTTTTTTCCTCCAAGCGAGTCCTTCTTCAACCGCAA

-continued

CTGAAAGGGCTTCAGTGGGATTTTCTATAACTCTGCTTTTCTGGCCTGAGAAGTCCATTGCTACCAGGGAATTCT

CTGATATACTTCTCATAGGTGATATGCTCTGTGAACTGCAGCCACTTCTACCTTGATATGGATGCATATAATTCT

GGTACAGCTGCATGCCATACTTAAGCAATCTAATCGCGGTCACCCAGCACGTCCTACTCTGCTCTTCTTCTGCAC

AGAGCATTTTCAGGTCTCGGGGCCCTCCCGCTTTGTTAGGCTTAAAGCAGAATCCATAGTTAGTCGGTGCTCCAT

GTTTTTTTTTGCCTGCCAGTGACACATAAATATCACTATTGCCAAATTCGCTGAAAAACTGCAAATGCCGCGGTT

CCTTTGATGTTCCTTTAGTAGAAAAATATAAACCAGATCTTCTTAGAAAAAAGTAAATTTTTTTCCAAGACTTCT

TTCCCTGTTCTTTCGCATGTAAGAAACCATGAATTTCAGGATATGTGCTTGAACTCAGAAACATCTGCAAAATCT

GTGTGGGGGATATTTCACCATTGGTTTCAGTTGCAAAAGATACCATATGCTCTGGAAAAAAATACATTGGGTTTT

TAAAGAACTCATATTTGGCATAATTTTTTCTAAAGTATAGTTTGTTTTCTTCTTCTATCCCCCAGTTGGATAGCA

CTTCAATCACCAGTTCGTGGTCTTCTATTGTTCTTTCTACACCTATGTGAGGCAGGTGCTCAAAAAGGGTCCAGC

TGTGGTCATCAATGTAATGATTCTTCAGGATCAACAGCTGACAAACATCTCGAGCCGTTATGTCACTGGGTACAT

CTAAAGCCCTGCTGGTTTCATCTTCACTGTATACTTTAATCACCCTTTTCTGTAGAATTATTGGCGTTATTGCAG

GCAGAGTGACTCTTCTTGCACTCAAACTCATGCCTGCTCTTCTTAGAATGATCCTGTCTCGTAGGTCATGGACAA

AATAAAAGAAATCTTTTATGGTTACTCCTTGGGAATCTCAGGGCTCAGTGCAATGAAACAACTAGGAAAGTAAT

>NM_016719.1 *Mus musculus* growth factor receptor bound protein 14 (Grb14), mRNA

SEQ ID NO: 33

GCGGCCCTGCCACCGCACCTGCAAGGCGCTCGCTGCCTGCAACCGCTCGGCTCTGCTCGCCCCCAGCCCTTCGTA

GCTTTCGCCTCGCGGTCGATGACTCCCTAGACCCCTGGCCTACGACCATGACCACGTCCCTGCAAGACGGGCAGA

GCGCCGCGGGCCGGGCAGGCGCCCAGGATTCGCCGCTGGCAGTGCAGGTGTGCCGCGTTGCCCAGGGCAAGGGAG

ACGCCCAGGACCCGGCGCAGGTCCCCGGACTGCACGCGCTGTCCCCCGCCTCCGATGCGACCCTCCGCGGTGCCA

TAGACAGGAGAAAAATGAAAGATCTGGATGTTCTGGAAAAGCCACCCATTCCCAACCCCTTTCCTGAGCTCTGCT

GCTCTCCGCTTACATCTGTGCTGTCAGCAGGCCTGTTTCCCAGGGCCAATTCAAGGAAGAAGCAGGTGATTAAAG

TTTACAGCGAGGATGAAACCAGCAGAGCATTAGAGGTGCCCAGTGACATCACAGCCCGAGATGTTTGCCAGCTGT

TGATCCTGAAGAACCACTATGTGGACGACAACAGCTGGACCCTTTTTGAGCACCTATCTCACATAGGTTTAGAAA

GAACCGTAGAGGACCACGAGCTGCCAACTGAAGTGCTGTCTCACTGGGGAGTGGAAGAAGACAATAAGCTGTATC

TTAGAAAGAATTATGCCAAATATGAATTTTTTAAGAACCCAATGTATTTCTTTCCAGAGCACATGGTGTCTTTTG

CAGCTGAAATGAATGGTGACAGATCCCCTACACAGATACTGCAGGTGTTTTTAAGCTCCAGCACGTATCCTGAAA

TCCATGGCTTCTTACATGCAAAGGAACAGGGAAAGAAGTCTTGGAAAAAAGCTTACTTTTTTCTCAGAAGATCTG

GCTTATATTTTTCTACTAAAGGCACATCCAAGGAACCACGGCATTTGCAGCTTTTCAGTGAATTCAGCACTAGTC

ACGTTTATATGTCACTGGCAGGAAAAAAAAAACACGGAGCGCCAACTCCCTATGGATTCTGCTTAAAGCCTAACA

AAGCAGGAGGGCCCCGGGACCTGAAAATGCTCTGTGCAGAAGAAGAGCAGAGCAGGACGTGCTGGGTGACCGCCA

TCCGACTGCTGAAGGATGGCATGCAGCTGTATCAGAATTATATGCATCCATACCAAGGTAGAAGCGCCTGCAATT

CTCAGAGCATGTCACCCATGAGAAGCGTATCAGAGAATTCCCTAGTAGCAATGGACTTCTCAGGTGAGAAGAGCA

GAGTCATAGACAACCCCACTGAAGCGCTTTCGGTTGCTGTTGAGGAAGGCCTCGCGTGGAGGAAAAAAGGCTGTT

TACGCCTGGGGAATCACGGAAGCCCCAGTGCCCCCTCCCAGAGCTCTGCTGTGAACATGGCTCTCCATCGGTCCC

AACCATGGTTTCACCACAGAATTTCCAGAGATGAGGCTCAGCGGCTGATCATTCGGCAGGGGCCTGTGGATGGAG

TTTTCTTGGTACGGGATAGTCAGAGTAACCCCAGAACTTTTGTACTGTCAATGAGTCATGGACAAAAGATAAAAC

ACTATCAAATTATACCCGTAGAAGATGATGGTGAGCTGTTCCATACTCTGGATGATGGCCATACGAAGTTCACAG

ACCTCATCCAGCTGGTGGAGTTCTACCAGCTCAACAGGGGGGTCCTTCCTTGCAAGCTGAAGCATTACTGTGCTA

GGATGGCTGTTTAGCCAAACTGTGTGTCACTCGTTACACTACAGAAGAAGAAGGATGCAAAGGAGAATGATTAGA

GAGAGAGAGAGAGATCACAAGGCTGAAAACAAATCATGGTGAAAAGAAGATTTCACCTGCGGGTTACAAAAAAA

-continued

ATAGGTCACACATTGCAAATTAGTGAAAACTTGGATTCCTATTACACTCATGACTTTAAATTTATTAGTTAAAAT

TAAACCTTATTAAAAAAAAAAAAAAAAA

>Reverse Complement of SEQ ID NO: 33

SEQ ID NO: 34

TTTTTTTTTTTTTTTTTAATAAGGTTTAATTTTAACTAATAAATTTAAAGTCATGAGTGTAATAGGAATCCAAGT

TTTCACTAATTTGCAATGTGTGACCTATTTTTTTTTGTAACCCGCAGGTGAAATCTTCTTTTCACCATGATTTGT

TTTCAGCCTTGTGATCTCTCTCTCTCTCTCTAATCATTCTCCTTTGCATCCTTCTTCTTCTGTAGTGTAACGAGT

GACACACAGTTTGGCTAAACAGCCATCCTAGCACAGTAATGCTTCAGCTTGCAAGGAAGGACCCCCCTGTTGAGC

TGGTAGAACTCCACCAGCTGGATGAGGTCTGTGAACTTCGTATGGCCATCATCCAGAGTATGGAACAGCTCACCA

TCATCTTCTACGGGTATAATTTGATAGTGTTTTATCTTTTGTCCATGACTCATTGACAGTACAAAAGTTCTGGGG

TTACTCTGACTATCCCGTACCAAGAAAACTCCATCCACAGGCCCCTGCCGAATGATCAGCCGCTGAGCCTCATCT

CTGGAAATTCTGTGGTGAAACCATGGTTGGGACCGATGGAGAGCCATGTTCACAGCAGAGCTCTGGGAGGGGGCA

CTGGGGCTTCCGTGATTCCCCAGGCGTAAACAGCCTTTTTTCCTCCACGCGAGGCCTTCCTCAACAGCAACCGAA

AGCGCTTCAGTGGGGTTGTCTATGACTCTGCTCTTCTCACCTGAGAAGTCCATTGCTACTAGGGAATTCTCTGAT

ACGCTTCTCATGGGTGACATGCTCTGAGAATTGCAGGCGCTTCTACCTTGGTATGGATGCATATAATTCTGATAC

AGCTGCATGCCATCCTTCAGCAGTCGGATGGCGGTCACCCAGCACGTCCTGCTCTGCTCTTCTTCTGCACAGAGC

ATTTTCAGGTCCCGGGGCCCTCCTGCTTTGTTAGGCTTTAAGCAGAATCCATAGGGAGTTGGCGCTCCGTGTTTT

TTTTTTCCTGCCAGTGACATATAAACGTGACTAGTGCTGAATTCACTGAAAAGCTGCAAATGCCGTGGTTCCTTG

GATGTGCCTTTAGTAGAAAAATATAAGCCAGATCTTCTGAGAAAAAAGTAAGCTTTTTTCCAAGACTTCTTTCCC

TGTTCCTTTGCATGTAAGAAGCCATGGATTTCAGGATACGTGCTGGAGCTTAAAAACACCTGCAGTATCTGTGTA

GGGGATCTGTCACCATTCATTTCAGCTGCAAAAGACACCATGTGCTCTGGAAAGAAATACATTGGGTTCTTAAAA

AATTCATATTTGGCATAATTCTTTCTAAGATACAGCTTATTGTCTTCTTCCACTCCCCAGTGAGACAGCACTTCA

GTTGGCAGCTCGTGGTCCTCTACGGTTCTTTCTAAACCTATGTGAGATAGGTGCTCAAAAAGGGTCCAGCTGTTG

TCGTCCACATAGTGGTTCTTCAGGATCAACAGCTGGCAAACATCTCGGGCTGTGATGTCACTGGGCACCTCTAAT

GCTCTGCTGGTTTCATCCTCGCTGTAAACTTTAATCACCTGCTTCTTCCTTGAATTGGCCCTGGGAAACAGGCCT

GCTGACAGCACAGATGTAAGCGGAGAGCAGCAGAGCTCAGGAAAGGGGTTGGGAATGGGTGGCTTTTCCAGAACA

TCCAGATCTTTCATTTTTCTCCTGTCTATGGCACCGCGGAGGGTCGCATCGGAGGCGGGGGACAGCGCGTGCAGT

CCGGGGACCTGCGCCGGGTCCTGGGCGTCTCCCTTGCCCTGGGCAACGCGGCACACCTGCACTGCCAGCGGCGAA

TCCTGGGCGCCTGCCCGGCCCGCGGCGCTCTGCCCGTCTTGCAGGGACGTGGTCATGGTCGTAGGCCAGGGGTCT

AGGGAGTCATCGACCGCGAGGCGAAAGCTACGAAGGGCTGGGGGCGAGCAGAGCCGAGCGGTTGCAGGCAGCGAG

CGCCTTGCAGGTGCGGTGGCAGGGCCGC

>NM_031623.1 *Rattus norvegicus* growth factor receptor bound protein 14 (Grb14), mRNA

SEQ ID NO: 35

GCTGGACCCCAGCCTTTCTTCGCTTTCGCCTCGCGGTCGATGACTCCCTAGACCCCCTGGCCTACGATCATGACC

ACGTCCCTGCAAGATGGGCAGAGCGCCGCGGGCCGGGCGGGCGCCCAGGACTCCCCGCTGGCAGTGCAGGTGTGC

CGCGTTGCCCAGGGCAAGGGAGACGCCCAGGACCCGGCTCAGGTCCCCGGACTGCACGCGCTGTCCCCCGGCCTCA

GATGCGACCCGCCGCGGTGCCATGGACAGGAGAAAAAGCGAAAGATCTGGAAGTTCAGGAAACGCCTTCCATTCCT

AACCCCTTCCCTGAGCTCTGCTGTTCTCCACTTACATCGGTGCTGTCAGCAGGCCTCTTCCCCAGATCAAATTCA

AGGAAGAAACAGGTGATTAAAGTTTACAGCGAGGATGAGACCAGCAGAGCGTTAGAGGTGCCCAGTGACGTCACA

GCCCGTGATGTCTGCCAGCTGTTGATCCTGAAGAACCACTATGTCGACGACAATAGCTGGACCCTTTTTGAGCAC

CTGTCTCACACAGGCGTAGAAAGGACAGTGGAGGACCATGAGCTGCTGACTGAAGTGCTGTCTCATTGGGTGATG

GAAGAAGATAATAAGCTGTATCTTAGAAAGAATTATGCCAAATATGAATTTTTTAAGAACCCAATGTATTTCTTT

-continued

CCAGAGCACATGGTGTCTTTTGCAACTGAAATGAACGGTGACAGATCCCTTACACAGATCCCGCAGGTGTTTTTA
AGCTCAAACACATATCCTGAAATCCATGGCTTCCTGCATGCAAAGGAACAGGGGAAGAAGTCTTGGAAAAAAGCT
TACTTTTTTCTCAGAAGATCTGGTTTATATTTTTCTACTAAAGGCACATCCAAGGAACCACGGCACTTGCAGTTT
TTCAGTGAATTCAGCACTAGTAATGTTTACATGTCACTGGCAGGCAAAAAAAAGCATGGAGCGCCGACTCCCTAT
GGATTCTGCTTTAAGCCTACCAAAGCAGGAGGGCCCCGGGACCTGAAAATGCTGTGTGCAGAAGAAGACCAAAGC
AGGATGTGCTGGGTGACCGCCATTAGATTGCTCAAGTATGGCATGCAGCTCTACCAGAATTATATGCATCCATCC
CAAGCTAGAAGCGCCTGCAGTTCTCAGAGCGTATCACCCATGAGAAGCGTATCAGAGAATTCCCTAGTAGCAATG
GACTTCTCAGGTCAGAAGACCAGAGTCATAGACAACCCCACTGAAGCCCTTTCGGTTGCCGTTGAGGAAGGACTC
GCTTGGAGGAAAAAAGGATGTTTACGCCTGGGGAATCATGGGAGTCCCACTGCGCCCTCTCAGAGCTCTGCTGTG
AACATGGCTCTCCACCGGTCCCAGCCATGGTTTCACCACAGAATTTCTAGAGATGAAGCTCAGCAGTTGATTACC
CGGCAGGGGCCTGTGGATGGAGTTTTCTTGGTACGGGATAGTCAGAGTAACCCCAGAACTTTTGTACTGTCAATG
AGTCACGGACAAAAGATAAAACACTTTCAAATTATACCCGTGGAAGATGATGGTGAGGTGTTCCACACCCTGGAT
GATGGCCATACGAAGTTCACAGATCTCATCCAGCTCGTGGAGTTCTACCAGCTCAACAAGGGGGTCCTTCCTTGC
AAGCTGAAGCATTACTGTGCTAGGATGGCTGTTTAGCCAAACTGTCTGTGACTCGTTAAACTATGGAAGATGGAG
GATGCAAAGAAGAATGATTAGAGAGAGAGAGAGAGAGAGAGAGAGAGAGAGAGAGAGAGAGAGAGAGAGAGGAGA
TCACAAGGCTGGAAACAAATCATGGTGAAAAGAAGATTCACCTGTGGGTTACAAAAAAATAGGTCACGTATTGCA
AATTAGTGAAGACTTGGATTCGTATTACTCTCGTTACTTTAAATTTATTAGTTAAAATTAAACCTTATTAAAAA

>Reverse Complement of SEQ ID NO: 35

SEQ ID NO: 36

TTTTTAATAAGGTTTAATTTTAACTAATAAATTTAAAGTAACGAGAGTAATACGAATCCAAGTCTTCACTAATT
TGCAATACGTGACCTATTTTTTTGTAACCCACAGGTGAATCTTCTTTTCACCATGATTTGTTTCCAGCCTTGTGA
TCTCCTCTCTCTCTCTCTCTCTCTCTCTCTCTCTCTCTCTCTCTCTCTCTCTCTCTAATCATTCTTCTTTGCATC
CTCCATCTTCCATAGTTTAACGAGTCACAGACAGTTTGGCTAAACAGCCATCCTAGCACAGTAATGCTTCAGCTT
GCAAGGAAGGACCCCCTTGTTGAGCTGGTAGAACTCCACGAGCTGGATGAGATCTGTGAACTTCGTATGGCCATC
ATCCAGGGTGTGGAACACCTCACCATCATCTTCCACGGGTATAATTTGAAAGTGTTTTATCTTTTGTCCGTGACT
CATTGACAGTACAAAAGTTCTGGGGTTACTCTGACTATCCCGTACCAAGAAAACTCCATCCACAGGCCCCTGCCG
GGTAATCAACTGCTGAGCTTCATCTCTAGAAATTCTGTGGTGAAACCATGGCTGGGACCGGTGGAGAGCCATGTT
CACAGCAGAGCTCTGAGAGGGCGCAGTGGGACTCCCATGATTCCCCAGGCGTAAACATCCTTTTTTCCTCCAAGC
GAGTCCTTCCTCAACGGCAACCGAAAGGGCTTCAGTGGGGTTGTCTATGACTCTGGTCTTCTGACCTGAGAAGTC
CATTGCTACTAGGGAATTCTCTGATACGCTTCTCATGGGTGATACGCTCTGAGAACTGCAGGCGCTTCTAGCTTG
GGATGGATGCATATAATTCTGGTAGAGCTGCATGCCATACTTGAGCAATCTAATGGCGGTCACCCAGCACATCCT
GCTTTGGTCTTCTTCTGCACACAGCATTTTCAGGTCCCGGGGCCCTCCTGCTTTGGTAGGCTTAAAGCAGAATCC
ATAGGGAGTCGGCGCTCCATGCTTTTTTTTGCCTGCCAGTGACATGTAAACATTACTAGTGCTGAATTCACTGAA
AAACTGCAAGTGCCGTGGTTCCTTGGATGTGCCTTTAGTAGAAAAATATAAACCAGATCTTCTGAGAAAAAAGTA
AGCTTTTTTCCAAGACTTCTTCCCCTGTTCCTTTGCATGCAGGAAGCCATGGATTTCAGGATATGTGTTTGAGCT
TAAAAACACCTGCGGGATCTGTGTAAGGGATCTGTCACCGTTCATTTCAGTTGCAAAAGACACCATGTGCTCTGG
AAAGAAATACATTGGGTTCTTAAAAAATTCATATTTGGCATAATTCTTTCTAAGATACAGCTTATTATCTTCTTC
CATCACCCAATGAGACAGCACTTCAGTCAGCAGCTCATGGTCCTCCACTGTCCTTTCTACGCCTGTGTGAGACAG
GTGCTCAAAAAGGGTCCAGCTATTGTCGTCGACATAGTGGTTCTTCAGGATCAACAGCTGGCAGACATCACGGGC
TGTGACGTCACTGGGCACCTCTAACGCTCTGCTGGTCTCATCCTCGCTGTAAACTTTAATCACCTGTTTCTTCCT
TGAATTTGATCTGGGGAAGAGGCCTGCTGACAGCACCGATGTAAGTGGAGAACAGCAGAGCTCAGGGAAGGGGTT

-continued

AGGAATGGAAGGCGTTTCCTGAACTTCCAGATCTTTCGCTTTTCTCCTGTCCATGGCACCGCGGCGGGTCGCATC

TGAGGCCGGGGACAGCGCGTGCAGTCCGGGGACCTGAGCCGGGTCCTGGGCGTCTCCCTTGCCCTGGGCAACGCG

GCACACCTGCACTGCCAGCGGGGAGTCCTGGGCGCCCGCCCGGCCCGCGGCGCTCTGCCCATCTTGCAGGGACGT

GGTCATGATCGTAGGCCAGGGGGTCTAGGGAGTCATCGACCGCGAGGCGAAAGCGAAGAAAGGCTGGGGTCCAGC

>XM_015110244.2 PREDICTED: *Macaca mulatta* growth factor receptor bound protein 14 (GRB14), transcript variant X1, mRNA

SEQ ID NO: 37

AAGAAGAGGCACGTGGGGAAGGACTGGGGCAAACCCAGCCCCCTGGTGCCCTGGCCTCCTGCCCTCCTGGCCCGG

TAGGGACTGTCATGGCGGCCCAGCAACAGCTTAGGTGATCTCAGATGGCAGAGCAGGAAGAATGCAAGGGTATGA

GGGTCAGGGCTGCGCAGACCCCTGTCCCGCCTGCGGTCCTCCCGGCAAGCCCAGGGGGAGAGCCCGCTCTGCTGG

GTCTCCGCCTCCAGCGGCGCCGGGCCGCCCAGACCCTGGGCTCAGTCTTGCGCCCCGGTGCCCACCTGGGGAGGC

GGCGGTCCCGGCCTCGCGTCCCGGATCGGACGGCGCGGGAGCGATGCCAGCGGCCCCGAGCGCCCCGGGCCACGC

GCGGGGCCGGCCGGACGCTCTCGCGCCCTCCCAGCCCCCTCCGCGGCTCGCCCCGCCGCCCGCGGCCCCCACCCA

CCGGCCGCTCCTCCCCTCTCCCCACCCTCCTCCTCCGCCCCCTCCCCTCCCCCGCCGCCTCGCAGATTGCTCGGC

AGCGTGTCTCAGCCGCCGGGGCTCCGAGCGCAGGCTGCGAGGCCACCACACCTGCAGAGCGCTCGGGCTGCCTAG

CCGGCACCTCGCCTCCGGCCGCGCGGTCCCCTTCTCCCCACGCGCCGAGTGTCCCATGACGCCCGAGCCCCCCGG

CCGGCGACAATGACCACTTCCCTGCAAGATGGGCAGAGCGCCGCGGGCAGGGCGGCTGCCCGGGATTCGCCGCTG

GCCGCCCAGGTGTGCGGCGCTGCCCAGGGGAGGGGCGACGCCCACGACCTGGCGCCCGGCCCCTGGCTGCACGCG

GGAGCGCTCCTGCCCCCTCCGGACGGGACCCGCGGCTGTGCTGCAGACAGGAGAAAAAAGAAAGATCTTGATGTT

CCGGAAATGCCATCTATTCCAAACCCTTTTCCTGAGCTATGCTGTTCTCCATTTACATCTGTGTTGTCAGCAGAC

CTGTTTCCCAAAGCAAATTCAAGGAAAAAACAGGTGATTAAAGTGTACAGTGAAGATGAAACCAGTAGGGCTTTA

GATGTACCCAGTGACATAACGGCTCGAGATGTTTGTCAGCTGTTGATCCTGAAGAATCATTACATTGATGACCAC

AGCTGGACCCTTTTTGAGCACCTGCCTCACATAGGTGTAGAAAGAACAATAGAAGACCATGAACTGGTGATTGAA

GTGCTATCCAACTGGGGGATAGAAGAAGAAAACAAGCTATACTTTAGAAAAAATTATGCCAAATATGAGTTCTTT

AAAAACCCAATGTATTTTTTTCCAGAGCATATGGTATCTTTTGCAACTGAAACCAATGGTGAAATATCCCCCACA

CAGATTTTGCAGATGTTTCTGAGTTCAAGCACATACCCTGAAATTCATGGTTTCTTACATGCGAAAGAACAGGGA

AAGAAGTCTTGGAAAAAAATTTACTTTTTTCTAAGAAGATCTGGTTTATATTTTTCTACTAAAGGGACATCAAAG

GAACCGCGGCATTTGCAGTTTTTCAGCGAATTTGGCAATAGTGATATTTATGTGTCACTGGCAGGCAAAAAAAAG

CATGGAGCACCGACTAACTATGGATTCTGCTTTAAGCCTAACAAAGCGGGAGGGCCCCGAGACCTGAAAATGCTC

TGTGCAGAAGAAGAGCAGAGTAGGACGTGCTGGGTGACCGCGATTAGATTGCTTAAGTATGGCATGCAGCTGTAC

CAGAATTATATGCATCCATATCAAGGTAGAAGTGGCTGCAGTTCACAGAGCATATCACCTATGAGAAGTATATCA

GAGAATTCCCTGGTAGCAATGGACTTCTCAGGCCAGAAAAGCAGAGTTATAGAAAATCCCACTGAAGCCCTTTCA

GTTGCAGTTGAAGAGGGACTCGCTTGGAGGAAAAAAGGATGTTTACGCCTGGGCACTCACGGTAGCCCCACTGCC

TCTTCACAGAGCTCTGCCACAAACATGGCTATCCACCGGTCCCAGCCATGGTTTCACCACAAAATTTCTAGAGAT

GAGGCTCAGCGATTGATTATTCAGCAAGGACTTGTGGATGGAGTTTTCTTGGTACGGGATAGTCAGAGTAACCCC

AAAACTTTCGTACTGTCAATGAGTCATGGACAAAAAATAAAGCACTTTCAAATTATACCAGTAGAAGATGACGGT

GAAATGTTCCACACACTGGATGATGGCCACACAAGATTTACAGATCTAATACAACTGGTGGAGTTCTATCAACTC

AATAAGGGCGTTCTTCCTTGCAAGTTGAAACATTATTGTGCTAGGATTGCTCTCTAGCTAAACCAGAAGTGACTT

ATTAAACTATTGAAGAAAAAGGACTCAAGAAAAATAATAAAAGACCATAAATAAGGGTGAAAATGTTACCATGTG

-continued

AAAAGAATGTATTTTACCTGCAAGTTACAAAAAAAATAGTTTGTGCATTGCAAATAAGCAAAGACTTGGATTGAC

TTTACATTCATCATTTAAAATTCATTAGTTAAAATTAAACCTTAGAAAAAAATTGA

>Reverse Complement of SEQ ID NO: 37

SEQ ID NO: 38

AAGAAGAGGCACGTGGGGAAGGACTGGGGCAAACCCAGCCCCCTGGTGCCCTGGCCTCCTGCCCTCCTGGCCCGG

TAGGGACTGTCATGGCGGCCCAGCAACAGCTTAGGTGATCTCAGATGGCAGAGCAGGAAGAATGCAAGGGTATGA

GGGTCAGGGCTGCGCAGACCCCTGTCCCGCCTGCGGTCCTCCCGGCAAGCCCAGGGGGAGAGCCCGCTCTGCTGG

GTCTCCGCCTCCAGCGGCGCCGGGCCGCCCAGACCCTGGGCTCAGTCTTGCGCCCCGGTGCCCACCTGGGGAGGC

GGCGGTCCCGGCCTCGCGTCCCGGATCGGACGGCGCGGGAGCGATGCCAGCGGCCCCGAGCGCCCCGGGCCACGC

GCGGGGCCGGCCGGACGCTCTCGCGCCCTCCCAGCCCCCTCCGCGGCTCGCCCCGCCGCCCGCGGCCCCCACCCA

CCGGCCGCTCCTCCCCTCTCCCCACCCTCCTCCTCCGCCCCCTCCCCTCCCCCGCCGCCTCGCAGATTGCTCGGC

AGCGTGTCTCAGCCGCCGGGGCTCCGAGCGCAGGCTGCGAGGCCACCACACCTGCAGAGCGCTCGGGCTGCCTAG

CCGGCACCTCGCCTCCGGCCGCGCGGTCCCCTTCTCCCCACGCGCCGAGTGTCCCATGACGCCCGAGCCCCCCGG

CCGGCGACAATGACCACTTCCCTGCAAGATGGGCAGAGCGCCGCGGGCAGGGCGGCTGCCCGGGATTCGCCGCTG

GCCGCCCAGGTGTGCGGCGCTGCCCAGGGGAGGGGCGACGCCCACGACCTGGCGCCCGGCCCCTGGCTGCACGCG

GGAGCGCTCCTGCCCCCTCCGGACGGGACCCGCGGCTGTGCTGCAGACAGGAGAAAAAAGAAAGATCTTGATGTT

CCGGAAATGCCATCTATTCCAAACCCTTTTCCTGAGCTATGCTGTTCTCCATTTACATCTGTGTTGTCAGCAGAC

CTGTTTCCCAAAGCAAATTCAAGGAAAAAACAGGTGATTAAAGTGTACAGTGAAGATGAAACCAGTAGGGCTTTA

GATGTACCCAGTGACATAACGGCTCGAGATGTTTGTCAGCTGTTGATCCTGAAGAATCATTACATTGATGACCAC

AGCTGGACCCTTTTTGAGCACCTGCCTCACATAGGTGTAGAAAGAACAATAGAAGACCATGAACTGGTGATTGAA

GTGCTATCCAACTGGGGGATAGAAGAAGAAAACAAGCTATACTTTAGAAAAAATTATGCCAAATATGAGTTCTTT

AAAAACCCAATGTATTTTTTTCCAGAGCATATGGTATCTTTTGCAACTGAAACCAATGGTGAAATATCCCCCACA

CAGATTTTGCAGATGTTTCTGAGTTCAAGCACATACCCTGAAATTCATGGTTTCTTACATGCGAAAGAACAGGGA

AAGAAGTCTTGGAAAAAAATTTACTTTTTTCTAAGAAGATCTGGTTTATATTTTTCTACTAAAGGGACATCAAAG

GAACCGCGGCATTTGCAGTTTTTCAGCGAATTTGGCAATAGTGATATTTATGTGTCACTGGCAGGCAAAAAAAAG

CATGGAGCACCGACTAACTATGGATTCTGCTTTAAGCCTAACAAAGCGGGAGGGCCCCGAGACCTGAAAATGCTC

TGTGCAGAAGAAGAGCAGAGTAGGACGTGCTGGGTGACCGCGATTAGATTGCTTAAGTATGGCATGCAGCTGTAC

CAGAATTATATGCATCCATATCAAGGTAGAAGTGGCTGCAGTTCACAGAGCATATCACCTATGAGAAGTATATCA

GAGAATTCCCTGGTAGCAATGGACTTCTCAGGCCAGAAAAGCAGAGTTATAGAAAATCCCACTGAAGCCCTTTCA

GTTGCAGTTGAAGAGGGACTCGCTTGGAGGAAAAAAGGATGTTTACGCCTGGGCACTCACGGTAGCCCCACTGCC

TCTTCACAGAGCTCTGCCACAAACATGGCTATCCACCGGTCCCAGCCATGGTTTCACCACAAAATTTCTAGAGAT

GAGGCTCAGCGATTGATTATTCAGCAAGGACTTGTGGATGGAGTTTTCTTGGTACGGGATAGTCAGAGTAACCCC

AAAACTTTCGTACTGTCAATGAGTCATGGACAAAAAATAAAGCACTTTCAAATTATACCAGTAGAAGATGACGGT

GAAATGTTCCACACACTGGATGATGGCCACACAAGATTTACAGATCTAATACAACTGGTGGAGTTCTATCAACTC

AATAAGGGCGTTCTTCCTTGCAAGTTGAAACATTATTGTGCTAGGATTGCTCTCTAGCTAAACCAGAAGTGACTT

ATTAAACTATTGAAGAAAAAGGACTCAAGAAAAATAATAAAAGACCATAAATAAGGGTGAAAATGTTACCATGTG

AAAAGAATGTATTTTACCTGCAAGTTACAAAAAAAATAGTTTGTGCATTGCAAATAAGCAAAGACTTGGATTGAC

TTTACATTCATCATTTAAAATTCATTAGTTAAAATTAAACCTTAGAAAAAAATTGA

>XM_028830779.1 PREDICTED: *Macaca mulatta* growth factor receptor bound protein 14 (GRB14), transcript variant X2, mRNA

SEQ ID NO: 39

TTGCCATGCACGTGAATGTCAGACAATGAAGAGGAAGGCCATATGAATACTATGTGTCTAGTGGCTGATGCTGGC

CACAGACTTGGATCCCAGCCTGGTGGTACCCAAGAGGTGATTAAAGTGTACAGTGAAGATGAAACCAGTAGGGCT

-continued

TTAGATGTACCCAGTGACATAACGGCTCGAGATGTTTGTCAGCTGTTGATCCTGAAGAATCATTACATTGATGAC

CACAGCTGGACCCTTTTTGAGCACCTGCCTCACATAGGTGTAGAAAGAACAATAGAAGACCATGAACTGGTGATT

GAAGTGCTATCCAACTGGGGGATAGAAGAAGAAAACAAGCTATACTTTAGAAAAAATTATGCCAAATATGAGTTC

TTTAAAAACCCAATGTATTTTTTTCCAGAGCATATGGTATCTTTTGCAACTGAAACCAATGGTGAAATATCCCCC

ACACAGATTTTGCAGATGTTTCTGAGTTCAAGCACATACCCTGAAATTCATGGTTTCTTACATGCGAAAGAACAG

GGAAAGAAGTCTTGGAAAAAAATTTACTTTTTTCTAAGAAGATCTGGTTTATATTTTTCTACTAAAGGGACATCA

AAGGAACCGCGGCATTTGCAGTTTTTCAGCGAATTTGGCAATAGTGATATTTATGTGTCACTGGCAGGCAAAAAA

AAGCATGGAGCACCGACTAACTATGGATTCTGCTTTAAGCCTAACAAAGCGGGAGGGCCCCGAGACCTGAAAATG

CTCTGTGCAGAAGAAGAGCAGAGTAGGACGTGCTGGGTGACCGCGATTAGATTGCTTAAGTATGGCATGCAGCTG

TACCAGAATTATATGCATCCATATCAAGGTAGAAGTGGCTGCAGTTCACAGAGCATATCACCTATGAGAAGTATA

TCAGAGAATTCCCTGGTAGCAATGGACTTCTCAGGCCAGAAAAGCAGAGTTATAGAAAATCCCACTGAAGCCCTT

TCAGTTGCAGTTGAAGAGGGACTCGCTTGGAGGAAAAAAGGATGTTTACGCCTGGGCACTCACGGTAGCCCCACT

GCCTCTTCACAGAGCTCTGCCACAAACATGGCTATCCACCGGTCCCAGCCATGGTTTCACCACAAAATTTCTAGA

GATGAGGCTCAGCGATTGATTATTCAGCAAGGACTTGTGGATGGAGTTTTCTTGGTACGGGATAGTCAGAGTAAC

CCCAAAACTTTCGTACTGTCAATGAGTCATGGACAAAAAATAAAGCACTTTCAAATTATACCAGTAGAAGATGAC

GGTGAAATGTTCCACACACTGGATGATGGCCACACAAGATTTACAGATCTAATACAACTGGTGGAGTTCTATCAA

CTCAATAAGGGCGTTCTTCCTTGCAAGTTGAAACATTATTGTGCTAGGATTGCTCTCTAGCTAAACCAGAAGTGA

CTTATTAAACTATTGAAGAAAAAGGACTCAAGAAAAATAATAAAAGACCATAAATAAGGGTGAAAATGTTACCAT

GTGAAAAGAATGTATTTTACCTGCAAGTTACAAAAAAAATAGTTTGTGCATTGCAAATAAGCAAAGACTTGGATT

GACTTTACATTCATCATTTAAAATTCATTAGTTAAAATTAAACCTTAGAAAAAAATTGA

>Reverse Complement of SEQ ID NO: 39

SEQ ID NO: 40

TCAATTTTTTTCTAAGGTTTAATTTTAACTAATGAATTTTAAATGATGAATGTAAAGTCAATCCAAGTCTTTGCT

TATTTGCAATGCACAAACTATTTTTTTTGTAACTTGCAGGTAAAATACATTCTTTTCACATGGTAACATTTTCAC

CCTTATTTATGGTCTTTTATTATTTTTCTTGAGTCCTTTTTCTTCAATAGTTTAATAAGTCACTTCTGGTTTAGC

TAGAGAGCAATCCTAGCACAATAATGTTTCAACTTGCAAGGAAGAACGCCCTTATTGAGTTGATAGAACTCCACC

AGTTGTATTAGATCTGTAAATCTTGTGTGGCCATCATCCAGTGTGTGGAACATTTCACCGTCATCTTCTACTGGT

ATAATTTGAAAGTGCTTTATTTTTTGTCCATGACTCATTGACAGTACGAAAGTTTTGGGGTTACTCTGACTATCC

CGTACCAAGAAAACTCCATCCACAAGTCCTTGCTGAATAATCAATCGCTGAGCCTCATCTCTAGAAATTTTGTGG

TGAAACCATGGCTGGGACCGGTGGATAGCCATGTTTGTGGCAGAGCTCTGTGAAGAGGCAGTGGGGCTACCGTGA

GTGCCCAGGCGTAAACATCCTTTTTTCCTCCAAGCGAGTCCCTCTTCAACTGCAACTGAAAGGGCTTCAGTGGGA

TTTTCTATAACTCTGCTTTTCTGGCCTGAGAAGTCCATTGCTACCAGGGAATTCTCTGATATACTTCTCATAGGT

GATATGCTCTGTGAACTGCAGCCACTTCTACCTTGATATGGATGCATATAATTCTGGTACAGCTGCATGCCATAC

TTAAGCAATCTAATCGCGGTCACCCAGCACGTCCTACTCTGCTCTTCTTCTGCACAGAGCATTTTCAGGTCTCGG

GGCCCTCCCGCTTTGTTAGGCTTAAAGCAGAATCCATAGTTAGTCGGTGCTCCATGCTTTTTTTTGCCTGCCAGT

GACACATAAATATCACTATTGCCAAATTCGCTGAAAAACTGCAAATGCCGCGGTTCCTTTGATGTCCCTTTAGTA

GAAAAATATAAACCAGATCTTCTTAGAAAAAAGTAAATTTTTTTCCAAGACTTCTTTCCCTGTTCTTTCGCATGT

AAGAAACCATGAATTTCAGGGTATGTGCTTGAACTCAGAAACATCTGCAAAATCTGTGTGGGGGATATTTCACCA

TTGGTTTCAGTTGCAAAAGATACCATATGCTCTGGAAAAAAATACATTGGGTTTTTAAAGAACTCATATTTGGCA

TAATTTTTTCTAAAGTATAGCTTGTTTTCTTCTTCTATCCCCCAGTTGGATAGCACTTCAATCACCAGTTCATGG

TCTTCTATTGTTCTTTCTACACCTATGTGAGGCAGGTGCTCAAAAAGGGTCCAGCTGTGGTCATCAATGTAATGA

TTCTTCAGGATCAACAGCTGACAAACATCTCGAGCCGTTATGTCACTGGGTACATCTAAAGCCCTACTGGTTTCA

-continued

TCTTCACTGTACACTTTAATCACCTCTTGGGTACCACCAGGCTGGGATCCAAGTCTGTGGCCAGCATCAGCCACT

AGACACATAGTATTCATATGGCCTTCCTCTTCATTGTCTGACATTCACGTGCATGGCAA

>XM_015110245.2 PREDICTED: *Macaca mulatta* growth factor receptor bound protein 14 (GRB14), transcript variant X3, mRNA

SEQ ID NO: 41

CCTTAATTGGCTTTGGGTAGATTGGAATCACATAAGCAGGGTGACATTTATTACTTTCCTAGTTGTTTCATTGCA

CTGAGCCCTGAGATTCCTGTAAAAGATTTCTTTTATTTTGTCCATGACCTACAAGAGAGGATCATTCTAAGAAGA

GCAGGCATGAGTTTGAGTGCAAGAAGAGTCACTCTGCCTGCAATAACGCCAATAATTCTACAGAAAAGGGTGATT

AAAGTGTACAGTGAAGATGAAACCAGTAGGGCTTTAGATGTACCCAGTGACATAACGGCTCGAGATGTTTGTCAG

CTGTTGATCCTGAAGAATCATTACATTGATGACCACAGCTGGACCCTTTTTGAGCACCTGCCTCACATAGGTGTA

GAAAGAACAATAGAAGACCATGAACTGGTGATTGAAGTGCTATCCAACTGGGGGATAGAAGAAGAAAACAAGCTA

TACTTTAGAAAAAATTATGCCAAATATGAGTTCTTTAAAAACCCAATGTATTTTTTTCCAGAGCATATGGTATCT

TTTGCAACTGAAACCAATGGTGAAATATCCCCCACACAGATTTTGCAGATGTTTCTGAGTTCAAGCACATACCCT

GAAATTCATGGTTTCTTACATGCGAAAGAACAGGGAAAGAAGTCTTGGAAAAAAATTTACTTTTTTCTAAGAAGA

TCTGGTTTATATTTTTCTACTAAAGGGACATCAAAGGAACCGCGGCATTTGCAGTTTTTCAGCGAATTTGGCAAT

AGTGATATTTATGTGTCACTGGCAGGCAAAAAAAAGCATGGAGCACCGACTAACTATGGATTCTGCTTTAAGCCT

AACAAAGCGGGAGGGCCCCGAGACCTGAAAATGCTCTGTGCAGAAGAAGAGCAGAGTAGGACGTGCTGGGTGACC

GCGATTAGATTGCTTAAGTATGGCATGCAGCTGTACCAGAATTATATGCATCCATATCAAGGTAGAAGTGGCTGC

AGTTCACAGAGCATATCACCTATGAGAAGTATATCAGAGAATTCCCTGGTAGCAATGGACTTCTCAGGCCAGAAA

AGCAGAGTTATAGAAAATCCCACTGAAGCCCTTTCAGTTGCAGTTGAAGAGGGACTCGCTTGGAGGAAAAAAGGA

TGTTTACGCCTGGGCACTCACGGTAGCCCCACTGCCTCTTCACAGAGCTCTGCCACAAACATGGCTATCCACCGG

TCCCAGCCATGGTTTCACCACAAAATTTCTAGAGATGAGGCTCAGCGATTGATTATTCAGCAAGGACTTGTGGAT

GGAGTTTTCTTGGTACGGGATAGTCAGAGTAACCCCAAAACTTTCGTACTGTCAATGAGTCATGGACAAAAAATA

AAGCACTTTCAAATTATACCAGTAGAAGATGACGGTGAAATGTTCCACACACTGGATGATGGCCACACAAGATTT

ACAGATCTAATACAACTGGTGGAGTTCTATCAACTCAATAAGGGCGTTCTTCCTTGCAAGTTGAAACATTATTGT

GCTAGGATTGCTCTCTAGCTAAACCAGAAGTGACTTATTAAACTATTGAAGAAAAAGGACTCAAGAAAAATAATA

AAAGACCATAAATAAGGGTGAAAATGTTACCATGTGAAAAGAATGTATTTTACCTGCAAGTTACAAAAAAAATAG

TTTGTGCATTGCAAATAAGCAAAGACTTGGATTGACTTTACATTCATCATTTAAAATTCATTAGTTAAAATTAAA

CCTTAGAAAAAAATTGA

>Reverse Complement of SEQ ID NO: 41

SEQ ID NO: 42

TCAATTTTTTTCTAAGGTTTAATTTTAACTAATGAATTTTAAATGATGAATGTAAAGTCAATCCAAGTCTTTGCT

TATTTGCAATGCACAAACTATTTTTTTTGTAACTTGCAGGTAAAATACATTCTTTTCACATGGTAACATTTTCAC

CCTTATTTATGGTCTTTTATTATTTTTCTTGAGTCCTTTTTCTTCAATAGTTTAATAAGTCACTTCTGGTTTAGC

TAGAGAGCAATCCTAGCACAATAATGTTTCAACTTGCAAGGAAGAACGCCCTTATTGAGTTGATAGAACTCCACC

AGTTGTATTAGATCTGTAAATCTTGTGTGGCCATCATCCAGTGTGTGGAACATTTCACCGTCATCTTCTACTGGT

ATAATTTGAAAGTGCTTTATTTTTTGTCCATGACTCATTGACAGTACGAAAGTTTTGGGGTTACTCTGACTATCC

CGTACCAAGAAAACTCCATCCACAAGTCCTTGCTGAATAATCAATCGCTGAGCCTCATCTCTAGAAATTTTGTGG

TGAAACCATGGCTGGGACCGGTGGATAGCCATGTTTGTGGCAGAGCTCTGTGAAGAGGCAGTGGGGCTACCGTGA

GTGCCCAGGCGTAAACATCCTTTTTTCCTCCAAGCGAGTCCCTCTTCAACTGCAACTGAAAGGGCTTCAGTGGGA

TTTTCTATAACTCTGCTTTTCTGGCCTGAGAAGTCCATTGCTACCAGGGAATTCTCTGATATACTTCTCATAGGT

GATATGCTCTGTGAACTGCAGCCACTTCTACCTTGATATGGATGCATATAATTCTGGTACAGCTGCATGCCATAC

TTAAGCAATCTAATCGCGGTCACCCAGCACGTCCTACTCTGCTCTTCTTCTGCACAGAGCATTTTCAGGTCTCGG

-continued

GGCCCTCCCGCTTTGTTAGGCTTAAAGCAGAATCCATAGTTAGTCGGTGCTCCATGCTTTTTTTTGCCTGCCAGT

GACACATAAATATCACTATTGCCAAATTCGCTGAAAAACTGCAAATGCCGCGGTTCCTTTGATGTCCCTTTAGTA

GAAAAATATAAACCAGATCTTCTTAGAAAAAAGTAAATTTTTTTCCAAGACTTCTTTCCCTGTTCTTTCGCATGT

AAGAAACCATGAATTTCAGGGTATGTGCTTGAACTCAGAAACATCTGCAAAATCTGTGTGGGGGATATTTCACCA

TAATTTTTTCTAAAGTATAGCTTGTTTTCTTCTTCTATCCCCCAGTTGGATAGCACTTCAATCACCAGTTCATGG

TCTTCTATTGTTCTTTCTACACCTATGTGAGGCAGGTGCTCAAAAAGGGTCCAGCTGTGGTCATCAATGTAATGA

TTCTTCAGGATCAACAGCTGACAAACATCTCGAGCCGTTATGTCACTGGGTACATCTAAAGCCCTACTGGTTTCA

TCTTCACTGTACACTTTAATCACCCTTTTCTGTAGAATTATTGGCGTTATTGCAGGCAGAGTGACTCTTCTTGCA

CTCAAACTCATGCCTGCTCTTCTTAGAATGATCCTCTCTTGTAGGTCATGGACAAAATAAAAGAAATCTTTTACA

GGAATCTCAGGGCTCAGTGCAATGAAACAACTAGGAAAGTAATAAATGTCACCCTGCTTATGTGATTCCAATCTA

CCCAAAGCCAATTAAGG

>XM_008258679.2 PREDICTED: *Oryctolagus cuniculus* growth factor receptor bound protein 14 (GRB14), transcript variant X1, mRNA

SEQ ID NO: 43

TCCGCCCCCTCCCCTCCCCCGCCGCCTCGCAGACTGCTCAGCCGAGCTGCTGAGCCGCCGGGGCCGGAGCGCAGG

CGGCCAGGCCACCGCACCTGCAGGGCGCTCGGGCCGCCGAGCCGGCATCCCGCCTCCCGCCTCCCGACACCCCGC

AGCCTAGGCGCCCGGGCTCCCATGCCGCCTGAGCCCCCGGGCCGGCAACCATGACCACTTCCCTGCAAGATGGGC

AGAGCGCCGCGGACAGGGCGGCTGCCCGGGACTCGCCGCTGGCCGCCCAGGTGTGCGGCGCTGCCCAGGGAAGGG

ACGACGCCCACGACCCGGCGCGGGCCCCCTGGCTGCACGCGCGAGCTCTGGTGCCGGCTCCGGACGGGACCCGCG

GCTGTGCTGCAGACAGGAGAAAAAGAAAGATCTTGATGTTCTGGAAACGCCATCTATTCCAAACCCCTTTCCTG

AGCTCTGCTGTTCTCCATTTACATCTGTGTTGTCAGCAGGCCTCTTTCCCAAAGCAAATTCAAGGAAAAAACAGG

TGATTAAAGTGTACAGTGAAGATGAAACCAGCAGGGCTCTAGAGGTTCCCAGTGACATAACAGCCCGAGATGTTT

GCCAGTTGTTGATTCTAAAGAATCATTACGTCGATGACCACAGCTGGACACTCTTTGAGCATCTGCCTCACATAG

GTGTAGAAAGAATAATAGAAGACCATGAGCTAGTGACCGAAGTGCTATCCAACTGGGGAATGGAAGAAGAAAATA

AGTTATTCTTTCGAAAAAATTATGCCAAATATGAATTCTTTAAAAATCCAATGTATTTTTTTCCAGAGCATATGG

TGTCTTTTGCAACTGAAACCAATGGTGAAATTTCCCCCACACAGATTTTACAGATGTTTCTGAGTTCAACTACAT

ATCCTGAAATCCATGGCTTCTTACATGCAAAAGAACAGGGAAAGAAGTCCTGGAAAAAAATTTACTTCCTTCTGA

GAAGATCTGGTTTATATTTTTCTACTAAAGGGACATCAAAGGAACCACGACATTTGCAGTTTTTCAGCGAATTTG

GCAGTAGTGATATATATGTGTCACTGACAGGCAGAAAAAAACACGGAGCACCGACTCACTATGGATTCTGCTTTA

AGCCTAACAAAGCAGGAGGGCCCCGAGACCTGAAAATGCTCTGTGCAGAAGAAGAGCAGAGCAGGACGTGCTGGG

TGACTGCCATTCGATTACTTAAGTATGGCATGCAGCTCTACCAGAATTATATGCATCCATATCAAGGTAGAAGTG

GCTGCAGTTCTCAGAGTATATCACCCATGAGGAGTATATCAGAGAATTCTCTGGTAGCAATGGACTTCTCAGGTC

AGAAAAGCAGAGTTATCGAAAATCCCACAGAAGCCCTTTCAGTTGCAGTCGAAGAAGGACTTGCTTGGAGGAAAA

AAGGATGTTTACGCCTTGGCGTCCATGGTAGCCCCACTGCTTCTTCGCAGAGCAGTGCCGCAAACATGGCTATCC

ACCGCTCCCAACCCTGGTTTCACCACAAAATTTCTAGAGATGAAGCTCAGCGACTGATTATTCAGCAAGGACTTG

TAGATGGAGTTTTCTTGGTACGGGATAGTCAGAGTAACCCCAAAACTTTTGTACTATCAATGAGTCATGGACAAA

AAATAAAGCACTTTCAAATTATACCAATTGAAGATGATGGTGCAATGTTCCATACACTGGATGATGGCCACACAA

GATTTACAGATCTAATTCAACTGGTGGAGTTCTATCAACTCAATAAGGGTGTTCTTCCTTGCAAGTTGAAGCATT

ATTGTGCTAGGATGGCTCTTTAACCAAACCAGAAGTGACTTGTGAAACTATTGAAGGAAAAAGAACTCAAGAAGA

AAATTAAGAGAGAGACCATAAATAAGGGTGAAAATGTTAACCATGGGGAAAAGAATGTATTTCATCTCAAGTTAC

AAGAAAGAGTTATACATTGCAAATAAGCAAAGACTTGGATTGACATTATATTCATCATTTAAAGTTCATTAGTTA

AAAATTAAACTTTAGGAAAAAA

-continued

>Reverse Complement of SEQ ID NO: 45

SEQ ID NO: 44

TTTTTTCCTAAAGTTTAATTTTTAACTAATGAACTTTAAATGATGAATATAATGTCAATCCAAGTCTTTGCTTAT

TTGCAATGTATAACTCTTTCTTGTAACTTGAGATGAAATACATTCTTTTCCCCATGGTTAACATTTTCACCCTTA

TTTATGGTCTCTCTCTTAATTTTCTTCTTGAGTTCTTTTTCCTTCAATAGTTTCACAAGTCACTTCTGGTTTGGT

TAAAGAGCCATCCTAGCACAATAATGCTTCAACTTGCAAGGAAGAACACCCTTATTGAGTTGATAGAACTCCACC

AGTTGAATTAGATCTGTAAATCTTGTGTGGCCATCATCCAGTGTATGGAACATTGCACCATCATCTTCAATTGGT

ATAATTTGAAAGTGCTTTATTTTTTGTCCATGACTCATTGATAGTACAAAAGTTTTGGGGTTACTCTGACTATCC

CGTACCAAGAAAACTCCATCTACAAGTCCTTGCTGAATAATCAGTCGCTGAGCTTCATCTCTAGAAATTTTGTGG

TGAAACCAGGGTTGGGAGCGGTGGATAGCCATGTTTGCGGCACTGCTCTGCGAAGAAGCAGTGGGGCTACCATGG

ACGCCAAGGCGTAAACATCCTTTTTTCCTCCAAGCAAGTCCTTCTTCGACTGCAACTGAAAGGGCTTCTGTGGGA

TTTTCGATAACTCTGCTTTTCTGACCTGAGAAGTCCATTGCTACCAGAGAATTCTCTGATATACTCCTCATGGGT

GATATACTCTGAGAACTGCAGCCACTTCTACCTTGATATGGATGCATATAATTCTGGTAGAGCTGCATGCCATAC

TTAAGTAATCGAATGGCAGTCACCCAGCACGTCCTGCTCTGCTCTTCTTCTGCACAGAGCATTTTCAGGTCTCGG

GGCCCTCCTGCTTTGTTAGGCTTAAAGCAGAATCCATAGTGAGTCGGTGCTCCGTGTTTTTTTCTGCCTGTCAGT

GACACATATATATCACTACTGCCAAATTCGCTGAAAAACTGCAAATGTCGTGGTTCCTTTGATGTCCCTTTAGTA

GAAAAATATAAACCAGATCTTCTCAGAAGGAAGTAAATTTTTTTCCAGGACTTCTTTCCCTGTTCTTTTGCATGT

AAGAAGCCATGGATTTCAGGATATGTAGTTGAACTCAGAAACATCTGTAAAATCTGTGTGGGGGAAATTTCACCA

TTGGTTTCAGTTGCAAAAGACACCATATGCTCTGGAAAAAAATACATTGGATTTTTAAAGAATTCATATTTGGCA

TAATTTTTTCGAAAGAATAACTTATTTTCTTCTTCCATTCCCCAGTTGGATAGCACTTCGGTCACTAGCTCATGG

TCTTCTATTATTCTTTCTACACCTATGTGAGGCAGATGCTCAAAGAGTGTCCAGCTGTGGTCATCGACGTAATGA

TTCTTTAGAATCAACAACTGGCAAACATCTCGGGCTGTTATGTCACTGGGAACCTCTAGAGCCCTGCTGGTTTCA

TCTTCACTGTACACTTTAATCACCTGTTTTTTCCTTGAATTTGCTTTGGGAAAGAGGCCTGCTGACAACACAGAT

GTAAATGGAGAACAGCAGAGCTCAGGAAAGGGGTTTGGAATAGATGGCGTTTCCAGAACATCAAGATCTTTCTTT

TTTCTCCTGTCTGCAGCACAGCCGCGGGTCCCGTCCGGAGCCGGCACCAGAGCTCGCGCGTGCAGCCAGGGGGCC

CGCGCCGGGTCGTGGGCGTCGTCCCTTCCCTGGGCAGCGCCGCACACCTGGGCGGCCAGCGGCGAGTCCCGGGCA

GCCGCCCTGTCCGCGGCGCTCTGCCCATCTTGCAGGGAAGTGGTCATGGTTGCCGGCCCGGGGGCTCAGGCGGCA

TGGGAGCCCGGGCGCCTAGGCTGCGGGGTGTCGGGAGGCGGGAGGCGGGATGCCGGCTCGGCGGCCCGAGCGCCC

TGCAGGTGCGGTGGCCTGGCCGCCTGCGCTCCGGCCCCGGCGGCTCAGCAGCTCGGCTGAGCAGTCTGCGAGGCG

GCGGGGGAGGGGAGGGGGCGGA

SEQ ID NO: 45

TCCGCCCCCTCCCCTCCCCCGCCGCCTCGCAGACTGCTCAGCCGAGCTGCTGAGCCGCCGGGGCCGGAGCGCAGG

CGGCCAGGCCACCGCACCTGCAGGGCGCTCGGGCCGCCGAGCCGGCATCCCGCCTCCCGCCTCCCGACACCCCGC

AGCCTAGGCGCCCGGGCTCCCATGCCGCCTGAGCCCCCGGGCCGGCAACCATGACCACTTCCCTGCAAGATGGGC

AGAGCGCCGCGGACAGGGCGGCTGCCCGGGACTCGCCGCTGGCCGCCCAGGTGTGCGGCGCTGCCCAGGGAAGGG

ACGACGCCCACGACCCGGCGCGGGCCCCCTGGCTGCACGCGCGAGCTCTGGTGCCGGCTCCGGACGGGACCCGCG

GCTGTGCTGCAGACAGGAGAAAAAGAAAGATCTTGATGTTCTGGAAACGCCATCTATTCCAAACCCCTTTCCTG

AGCTCTGCTGTTCTCCATTTACATCTGTGTTGTCAGCAGGCCTCTTTCCCAAAGCAAATTCAAGGAAAAAACAGG

TGATTAAAGTGTACAGTGAAGATGAAACCAGCAGGGCTCTAGAGGTTCCCAGTGACATAACAGCCCGAGATGTTT

GCCAGTTGTTGATTCTAAAGAATCATTACGTCGATGACCACAGCTGGACACTCTTTGAGCATCTGCCTCACATAG

GTGTAGAAAGAATAATAGAAGACCATGAGCTAGTGACCGAAGTGCTATCCAACTGGGGAATGGAAGAAGAAAATA

AGTTATTCTTTCGAAAAAATTATGCCAAATATGAATTCTTTAAAAATCCAATGATGTTTCTGAGTTCAACTACAT

-continued

ATCCTGAAATCCATGGCTTCTTACATGCAAAAGAACAGGGAAAGAAGTCCTGGAAAAAAATTTACTTCCTTCTGA
GAAGATCTGGTTTATATTTTTCTACTAAAGGGACATCAAAGGAACCACGACATTTGCAGTTTTTCAGCGAATTTG
GCAGTAGTGATATATATGTGTCACTGACAGGCAGAAAAAAACACGGAGCACCGACTCACTATGGATTCTGCTTTA
AGCCTAACAAAGCAGGAGGGCCCCGAGACCTGAAAATGCTCTGTGCAGAAGAAGAGCAGAGCAGGACGTGCTGGG
TGACTGCCATTCGATTACTTAAGTATGGCATGCAGCTCTACCAGAATTATATGCATCCATATCAAGGTAGAAGTG
GCTGCAGTTCTCAGAGTATATCACCCATGAGGAGTATATCAGAGAATTCTCTGGTAGCAATGGACTTCTCAGGTC
AGAAAAGCAGAGTTATCGAAAATCCCACAGAAGCCCTTTCAGTTGCAGTCGAAGAAGGACTTGCTTGGAGGAAAA
AAGGATGTTTACGCCTTGGCGTCCATGGTAGCCCCACTGCTTCTTCGCAGAGCAGTGCCGCAAACATGGCTATCC
ACCGCTCCCAACCCTGGTTTCACCACAAAATTTCTAGAGATGAAGCTCAGCGACTGATTATTCAGCAAGGACTTG
TAGATGGAGTTTTCTTGGTACGGGATAGTCAGAGTAACCCCAAAACTTTTGTACTATCAATGAGTCATGGACAAA
AAATAAAGCACTTTCAAATTATACCAATTGAAGATGATGGTGCAATGTTCCATACACTGGATGATGGCCACACAA
GATTTACAGATCTAATTCAACTGGTGGAGTTCTATCAACTCAATAAGGGTGTTCTTCCTTGCAAGTTGAAGCATT
ATTGTGCTAGGATGGCTCTTTAACCAAACCAGAAGTGACTTGTGAAACTATTGAAGGAAAAAGAACTCAAGAAGA
AAATTAAGAGAGAGACCATAAATAAGGGTGAAAATGTTAACCATGGGGAAAAGAATGTATTTCATCTCAAGTTAC
AAGAAAGAGTTATACATTGCAAATAAGCAAAGACTTGGATTGACATTATATTCATCATTTAAAGTTCATTAGTTA
AAAATTAAACTTTAGGAAAAAA

>Reverse Complement of SEQ ID NO: 45

SEQ ID NO: 46

TTTTTTCCTAAAGTTTAATTTTTAACTAATGAACTTTAAATGATGAATATAATGTCAATCCAAGTCTTTGCTTAT
TTGCAATGTATAACTCTTTCTTGTAACTTGAGATGAAATACATTCTTTTCCCCATGGTTAACATTTTCACCCTTA
TTTATGGTCTCTCTCTTAATTTTCTTCTTGAGTTCTTTTTCCTTCAATAGTTTCACAAGTCACTTCTGGTTTGGT
TAAAGAGCCATCCTAGCACAATAATGCTTCAACTTGCAAGGAAGAACACCCTTATTGAGTTGATAGAACTCCACC
AGTTGAATTAGATCTGTAAATCTTGTGTGGCCATCATCCAGTGTATGGAACATTGCACCATCATCTTCAATTGGT
ATAATTTGAAAGTGCTTTATTTTTTGTCCATGACTCATTGATAGTACAAAAGTTTTGGGGTTACTCTGACTATCC
CGTACCAAGAAAACTCCATCTACAAGTCCTTGCTGAATAATCAGTCGCTGAGCTTCATCTCTAGAAATTTTGTGG
TGAAACCAGGGTTGGGAGCGGTGGATAGCCATGTTTGCGGCACTGCTCTGCGAAGAAGCAGTGGGGCTACCATGG
ACGCCAAGGCGTAAACATCCTTTTTTCCTCCAAGCAAGTCCTTCTTCGACTGCAACTGAAAGGGCTTCTGTGGGA
TTTTCGATAACTCTGCTTTTCTGACCTGAGAAGTCCATTGCTACCAGAGAATTCTCTGATATACTCCTCATGGGT
GATATACTCTGAGAACTGCAGCCACTTCTACCTTGATATGGATGCATATAATTCTGGTAGAGCTGCATGCCATAC
TTAAGTAATCGAATGGCAGTCACCCAGCACGTCCTGCTCTGCTCTTCTTCTGCACAGAGCATTTTCAGGTCTCGG
GGCCCTCCTGCTTTGTTAGGCTTAAAGCAGAATCCATAGTGAGTCGGTGCTCCGTGTTTTTTTCTGCCTGTCAGT
GACACATATATATCACTACTGCCAAATTCGCTGAAAAACTGCAAATGTCGTGGTTCCTTTGATGTCCCTTTAGTA
GAAAAATATAAACCAGATCTTCTCAGAAGGAAGTAAATTTTTTTCCAGGACTTCTTTCCCTGTTCTTTTGCATGT
AAGAAGCCATGGATTTCAGGATATGTAGTTGAACTCAGAAACATCATTGGATTTTTAAAGAATTCATATTTGGCA
TAATTTTTTCGAAAGAATAACTTATTTTCTTCTTCCATTCCCCAGTTGGATAGCACTTCGGTCACTAGCTCATGG
TCTTCTATTATTCTTTCTACACCTATGTGAGGCAGATGCTCAAAGAGTGTCCAGCTGTGGTCATCGACGTAATGA
TTCTTTAGAATCAACAACTGGCAAACATCTCGGGCTGTTATGTCACTGGGAACCTCTAGAGCCCTGCTGGTTTCA
TCTTCACTGTACACTTTAATCACCTGTTTTTTCCTTGAATTTGCTTTGGGAAAGAGGCCTGCTGACAACACAGAT
GTAAATGGAGAACAGCAGAGCTCAGGAAAGGGGTTTGGAATAGATGGCGTTTCCAGAACATCAAGATCTTTCTTT
TTTCTCCTGTCTGCAGCACAGCCGCGGGTCCCGTCCGGAGCCGGCACCAGAGCTCGCGCGTGCAGCCAGGGGGCC
CGCGCCGGGTCGTGGGCGTCGTCCCTTCCCTGGGCAGCGCCGCACACCTGGGCGGCCAGCGGCGAGTCCCGGGCA

-continued

GCCGCCCTGTCCGCGGCGCTCTGCCCATCTTGCAGGGAAGTGGTCATGGTTGCCGGCCCGGGGGCTCAGGCGGCA

TGGGAGCCCGGGCGCCTAGGCTGCGGGGTGTCGGGAGGCGGGAGGCGGGATGCCGGCTCGGCGGCCCGAGCGCCC

TGCAGGTGCGGTGGCCTGGCCGCCTGCGCTCCGGCCCCGGCGGCTCAGCAGCTCGGCTGAGCAGTCTGCGAGGCG

GCGGGGGAGGGGAGGGGGCGGA

>XM_017342898.1 PREDICTED: *Oryctolagus cuniculus* growth factor receptor bound protein 14 (GRB14), transcript variant X3, mRNA

SEQ ID NO: 47

CATTTATTACTTCCCTGGTTGTTTCTTTGCACTGAGCCCTGAGATTCCCAAGGAGTAACCGTTAAAGATTTCTTT

CATTTCGTCTATGACCTGCAAGGGGAAATCATTCTCAGAAGAGCAGGCATGAGTTTGAGTGCAAGAAGAGTGACT

CTGCCTGCAATAACACCACTAGTTCTACAGAAAAGGGTGATTAAAGTGTACAGTGAAGATGAAACCAGCAGGGCT

CTAGAGGTTCCCAGTGACATAACAGCCCGAGATGTTTGCCAGTTGTTGATTCTAAAGAATCATTACGTCGATGAC

CACAGCTGGACACTCTTTGAGCATCTGCCTCACATAGGTGTAGAAAGAATAATAGAAGACCATGAGCTAGTGACC

GAAGTGCTATCCAACTGGGGAATGGAAGAAGAAAATAAGTTATTCTTTCGAAAAAATTATGCCAAATATGAATTC

TTTAAAAAATCCAATGTATTTTTTTCCAGAGCATATGGTGTCTTTTGCAACTGAAACCAATGGTGAAATTTCCCCC

ACACAGATTTTACAGATGTTTCTGAGTTCAACTACATATCCTGAAATCCATGGCTTCTTACATGCAAAAGAACAG

GGAAAGAAGTCCTGGAAAAAAATTTACTTCCTTCTGAGAAGATCTGGTTTATATTTTTCTACTAAAGGGACATCA

AAGGAACCACGACATTTGCAGTTTTTCAGCGAATTTGGCAGTAGTGATATATATGTGTCACTGACAGGCAGAAAA

AAACACGGAGCACCGACTCACTATGGATTCTGCTTTAAGCCTAACAAAGCAGGAGGGCCCCGAGACCTGAAAATG

CTCTGTGCAGAAGAAGAGCAGAGCAGGACGTGCTGGGTGACTGCCATTCGATTACTTAAGTATGGCATGCAGCTC

TACCAGAATTATATGCATCCATATCAAGGTAGAAGTGGCTGCAGTTCTCAGAGTATATCACCCATGAGGAGTATA

TCAGAGAATTCTCTGGTAGCAATGGACTTCTCAGGTCAGAAAAGCAGAGTTATCGAAAATCCCACAGAAGCCCTT

TCAGTTGCAGTCGAAGAAGGACTTGCTTGGAGGAAAAAAGGATGTTTACGCCTTGGCGTCCATGGTAGCCCCACT

GCTTCTTCGCAGAGCAGTGCCGCAAACATGGCTATCCACCGCTCCCAACCCTGGTTTCACCACAAAATTTCTAGA

GATGAAGCTCAGCGACTGATTATTCAGCAAGGACTTGTAGATGGAGTTTTCTTGGTACGGGATAGTCAGAGTAAC

CCCAAAACTTTTGTACTATCAATGAGTCATGGACAAAAAATAAAGCACTTTCAAATTATACCAATTGAAGATGAT

GGTGCAATGTTCCATACACTGGATGATGGCCACACAAGATTTACAGATCTAATTCAACTGGTGGAGTTCTATCAA

CTCAATAAGGGTGTTCTTCCTTGCAAGTTGAAGCATTATTGTGCTAGGATGGCTCTTTAACCAAACCAGAAGTGA

CTTGTGAAACTATTGAAGGAAAAAGAACTCAAGAAGAAAATTAAGAGAGAGACCATAAATAAGGGTGAAAATGTT

AACCATGGGGAAAAGAATGTATTTCATCTCAAGTTACAAGAAAGAGTTATACATTGCAAATAAGCAAAGACTTGG

ATTGACATTATATTCATCATTTAAAGTTCATTAGTTAAAAATTAAACTTTAGGAAAAAA

>Reverse Complement of SEQ ID NO: 47

SEQ ID NO: 48

TTTTTTCCTAAAGTTTAATTTTTAACTAATGAACTTTAAATGATGAATATAATGTCAATCCAAGTCTTTGCTTAT

TTGCAATGTATAACTCTTTCTTGTAACTTGAGATGAAATACATTCTTTTCCCCATGGTTAACATTTTCACCCTTA

TTTATGGTCTCTCTCTTAATTTTCTTCTTGAGTTCTTTTTCCTTCAATAGTTTCACAAGTCACTTCTGGTTTGGT

TAAAGAGCCATCCTAGCACAATAATGCTTCAACTTGCAAGGAAGAACACCCTTATTGAGTTGATAGAACTCCACC

AGTTGAATTAGATCTGTAAATCTTGTGTGGCCATCATCCAGTGTATGGAACATTGCACCATCATCTTCAATTGGT

ATAATTTGAAAGTGCTTTATTTTTTGTCCATGACTCATTGATAGTACAAAAGTTTTGGGGTTACTCTGACTATCC

CGTACCAAGAAAACTCCATCTACAAGTCCTTGCTGAATAATCAGTCGCTGAGCTTCATCTCTAGAAATTTTGTGG

TGAAACCAGGGTTGGGAGCGGTGGATAGCCATGTTTGCGGCACTGCTCTGCGAAGAAGCAGTGGGGCTACCATGG

ACGCCAAGGCGTAAACATCCTTTTTTCCTCCAAGCAAGTCCTTCTTCGACTGCAACTGAAAGGGCTTCTGTGGGA

TTTTCGATAACTCTGCTTTTCTGACCTGAGAAGTCCATTGCTACCAGAGAATTCTCTGATATACTCCTCATGGGT

GATATACTCTGAGAACTGCAGCCACTTCTACCTTGATATGGATGCATATAATTCTGGTAGAGCTGCATGCCATAC

-continued

TTAAGTAATCGAATGGCAGTCACCCAGCACGTCCTGCTCTGCTCTTCTTCTGCACAGAGCATTTTCAGGTCTCGG

GGCCCTCCTGCTTTGTTAGGCTTAAAGCAGAATCCATAGTGAGTCGGTGCTCCGTGTTTTTTTCTGCCTGTCAGT

GACACATATATATCACTACTGCCAAATTCGCTGAAAAACTGCAAATGTCGTGGTTCCTTTGATGTCCCTTTAGTA

GAAAAATATAAACCAGATCTTCTCAGAAGGAAGTAAATTTTTTTCCAGGACTTCTTTCCCTGTTCTTTTGCATGT

AAGAAGCCATGGATTTCAGGATATGTAGTTGAACTCAGAAACATCTGTAAAATCTGTGTGGGGGAAATTTCACCA

TTGGTTTCAGTTGCAAAAGACACCATATGCTCTGGAAAAAAATACATTGGATTTTTAAAGAATTCATATTTGGCA

TAATTTTTTCGAAAGAATAACTTATTTTCTTCTTCCATTCCCCAGTTGGATAGCACTTCGGTCACTAGCTCATGG

TCTTCTATTATTCTTTCTACACCTATGTGAGGCAGATGCTCAAAGAGTGTCCAGCTGTGGTCATCGACGTAATGA

TTCTTTAGAATCAACAACTGGCAAACATCTCGGGCTGTTATGTCACTGGGAACCTCTAGAGCCCTGCTGGTTTCA

TCTTCACTGTACACTTTAATCACCCTTTTCTGTAGAACTAGTGGTGTTATTGCAGGCAGAGTCACTCTTCTTGCA

CTCAAACTCATGCCTGCTCTTCTGAGAATGATTTCCCCTTGCAGGTCATAGACGAAATGAAAGAAATCTTTAACG

GTTACTCCTTGGGAATCTCAGGGCTCAGTGCAAAGAAACAACCAGGGAAGTAATAAATG

SEQUENCE LISTING (2712 sequences)

SEQ ID NO: 1 - DNA, 5468 bp, Homo sapiens
gggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagacttgggaggctgcattctgataattctcaggaggaagaatgtataggagagaccagggtttttaaggtgtgacctctgaaccacctacatcagagctgactgcctctcgctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 2 - DNA, 5468 bp, Homo sapiens
tgaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccaatttacagtcactgcagtttgcactgtgacatcacaaatctaccgccagcttgcccgcccccagaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcgtcctggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagccgcccagcgcgaggccagcgagctggggccttaggaagtctgccgccacgtggaggcggtttacattctccaacaattcacttcggcagggaaaatacaaaagactacgtcaaaccagctacatacaaaactgtgaatcagagtcaagcttttgttctccttttaaataaacgcatatttataaatatgaaatactgcaaatacaagctgtctattggagagaggcgtgtgagagagagattatacactgatgggactggtctacgtacacagaaaaaagaaatcctagagttgtttttccttgaaaagggtttacctcgagccagtgaagaggaaggaatcgtggtgtaactgcaatgtccgtccctacagtgaagcctgccaccaggtgtgaacgtgagaattatcttactgtcaatagtttgaaagactgactggctgcgaaaggaagaaaatgcaattgagcactgatggttaaaaacatgttttgctagaaaattcttcatttgtatacctttcatggaaaacaactagagtgtggtctgtagactgacatacagtgttactatacggtagactgacttccagctgactggccttactgaagcttgtgacactgctctaggctacgggggttgactgaggagcagagaaatgctgttccttagggaacacttcagtggggcggatttggggcaatatcatggccagcacacattaatagaagccaggcaggtgttgtcttgaaaaaggaaatcattctgctcaccacagtagtttgtcgcctgtcaaaggagtcctttctgctttacagggatcaaaggtaaggaaatggccactctcacacctgatcactaagctaaggggacgtggcaaagggggccacccgaggggcggaggggaccaagtgacaactcaagccaccatctgactcatctcccggagcggggacaaagtgttgtgttgacaaaactcttccatgtccacaaccactgtgaggtacttctgaccctaagccagcagaggaggagcctctagctgctctgtgttcactggcttatgggggttttcagcaggacggagggctgcaagcaaagatctttaaatatcagcctgtgcctgtggcccctgcagcgtttccttgtctttatcactatggaaacccatgagacacagcacgaagacaaccaggtgccattttctctttagatcctttaatcccccgagggacatcagccgtgaaacgactcacaccactgcagcagcaggggtaaggcagtgatcgttctagaacaggctgaaggctgtggaaacgcaaggctgaagtacccaggtggattatgcagcatccaccgctggccgatgacgggtgccaggtgtgtctcaaggaggctggcccacgtcaatctagaggcgaggccattcagcctgctgtttgtggaacagtgaattttccaaaggaataaagtctcctgcactgtgcagaacaagacacactaataacaagaggatctgacatctgagcatagagaaatgattaacagactgtggttgcttgactgagtccacaaaatatgccaaatgcctaccacagtgacaccttttattttaacaagaaagcttttcaagtatactgggaagggctgggtttgtcatttgggagctgaatccacaccgtggtagtcggcagagggtgtggaggaccctctgggaacatttggggacccatattcagtttgaaatctgcccattcaaaactctttctgtattatatgagttgaaacgccacatccccctcctacaataggctgaatacaatattgaaaacaaagaaggagtgcaaaaaagtgatcaatacaaaaaaagtaaacatatcagttttaattgtcaagattattccagggcaagagttcatttccaatcacttctctccggttcttgttcctaagcggcccaagccaagatgatcattccagtttattttcaactttccgctggatcttccatgccctccccaatttggccgatgcagagggaggcgaccctgctgggttcacagcagcaaatcgtcgtttaagtccaacaaactagtcaatcttggtcggctggcaccgaacaaacccatctcgctctgggtccccaggtgcagaatcgatgtgtgttcttcaccaacgcacagaccgcttcttcactccagtgttcacttcctccagtcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccgtcgtcctcgcaaggtaagatctggaaatttttaattttctggtgatgacacagtgtgagtacaaatgcctttggattactctggctgtcacggaggagaaaaagcccatccacgagcccttgctgtttaatgatcctgtgggattcctccctggagatcctcccgtgaaaccagtgctgtgtcctgtgaatcactgtacttagggtagaagggtggaggggactttggctacctaggatgttcatccgtgtgcttcgcttcctccaggcgtggccctcctccagggctgcgctctgggcctctgccggattctctatcacgcgtcctgtttgcccagaaaaatccattgccacgagggagttctcggagacactgcgcactggcgtcgagaacggggacagcaaggccttcctctgctgagggattcggtaattctggtaaaggagcattccatacttgaggagtctgaacgctgtcatccagcacgtcctggtttgctcgtcctctgcacagagcaacctcagctctttagtttcattcctgactttgtttggctttatgcagagcccgtggtctgtaggggcgttgtactgcttcctgccagcgatcagggagaagatgttgctgtcctccaggtcggccagcagctgcaggtgtctgggttcctttgaagttcccttggtggagcaataaaggccagatctccgcaaacacacatacagctttttccatgatttctttcccagctctttcacatgcaaaaacccttgaatttcaggacaactactggagttcagaaaattctgcaaaagctgggtttgactgccatttgactgctggcaccaagtaaccatctgttctgggaagaaattcatgggatttttaaagaactcgtattttgcgtaattcttcctgaatagaaatttactctcactggccatggtactctccacctggaccaccagctcatggtcttccaagcacctctctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgctttgcggcggcctggctcggaggtaaagaacccggcgtgagcacaggggggctcccagggccacagagttcaggaaaaggattggggatggccggcagagatgaggttctaaactgctggtcttcctcctgaaggcgcctgacagcgaggatgtgcacaggctgggagcgctgcaccctctgcctcggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctcctggtgattcgcaagtcggtcagactgtgcggggagtcctggtcctgccgggtcttgttgactgcgaggtgtctgctccaccttgtcctggtagtacggatggtgcaaaaaggaatctgggcagccggctaaagccatgggttccttctgccttcttcaaattacatttactgcgctgcagcacctgtcaggagttggctctgtagcactgtctgctggggcggccaccctggcttcactgagaggacccaggtgaggacctggctgccggtcactgggctgctggtcactgagctaccagtcactgggcctgcagctgctgcttcctgctcagcattgtggtcagcgccaaagcgagaggcagtcagctctgatgtaggtggttcagaggtcacaccttaaaaaccctggtctctcctatacattcttcctcctgagaattatcagaatgcagcctcccaagtctggagagcgggcggcagcactggccgcacggggtcgctgcgtgtgcgccgccggcccgggtagggcttcggggcccggcccccgcagtgcccggcgcgtggacagcgctccgcatggacagcgctcggagccgggccgggctggtcctccacggctccgccccggccaggggcctgcggcgcagaaaaccgacccggggcctcggggccaccgcgcgccaggcgaacgcgctagcacgaaaagcgggccaacgccgcctctggggacgccatccgggcgagggtgggatgccgcgccaccgcccgagcgtgcccgggggctcccagcgccatcaccacgcaggtgcccgggggcccctccgcggagccggctgccgcccggctgcaatactcagcctccgagggactgggcgctcctgaggagcgggaggacgacggagcagcgcccggtcctggagcacaacaggaatccc

SEQ ID NO: 3 - DNA, 4562 bp, Homo sapiens
aaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 4 - DNA, 4562 bp, Homo sapiens
tgaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccaatttacagtcactgcagtttgcactgtgacatcacaaatctaccgccagcttgcccgcccccagaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcgtcctggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagccgcccagcgcgaggccagcgagctggggccttaggaagtctgccgccacgtggaggcggtttacattctccaacaattcacttcggcagggaaaatacaaaagactacgtcaaaccagctacatacaaaactgtgaatcagagtcaagcttttgttctccttttaaataaacgcatatttataaatatgaaatactgcaaatacaagctgtctattggagagaggcgtgtgagagagagattatacactgatgggactggtctacgtacacagaaaaaagaaatcctagagttgtttttccttgaaaagggtttacctcgagccagtgaagaggaaggaatcgtggtgtaactgcaatgtccgtccctacagtgaagcctgccaccaggtgtgaacgtgagaattatcttactgtcaatagtttgaaagactgactggctgcgaaaggaagaaaatgcaattgagcactgatggttaaaaacatgttttgctagaaaattcttcatttgtatacctttcatggaaaacaactagagtgtggtctgtagactgacatacagtgttactatacggtagactgacttccagctgactggccttactgaagcttgtgacactgctctaggctacgggggttgactgaggagcagagaaatgctgttccttagggaacacttcagtggggcggatttggggcaatatcatggccagcacacattaatagaagccaggcaggtgttgtcttgaaaaaggaaatcattctgctcaccacagtagtttgtcgcctgtcaaaggagtcctttctgctttacagggatcaaaggtaaggaaatggccactctcacacctgatcactaagctaaggggacgtggcaaagggggccacccgaggggcggaggggaccaagtgacaactcaagccaccatctgactcatctcccggagcggggacaaagtgttgtgttgacaaaactcttccatgtccacaaccactgtgaggtacttctgaccctaagccagcagaggaggagcctctagctgctctgtgttcactggcttatgggggttttcagcaggacggagggctgcaagcaaagatctttaaatatcagcctgtgcctgtggcccctgcagcgtttccttgtctttatcactatggaaacccatgagacacagcacgaagacaaccaggtgccattttctctttagatcctttaatcccccgagggacatcagccgtgaaacgactcacaccactgcagcagcaggggtaaggcagtgatcgttctagaacaggctgaaggctgtggaaacgcaaggctgaagtacccaggtggattatgcagcatccaccgctggccgatgacgggtgccaggtgtgtctcaaggaggctggcccacgtcaatctagaggcgaggccattcagcctgctgtttgtggaacagtgaattttccaaaggaataaagtctcctgcactgtgcagaacaagacacactaataacaagaggatctgacatctgagcatagagaaatgattaacagactgtggttgcttgactgagtccacaaaatatgccaaatgcctaccacagtgacaccttttattttaacaagaaagcttttcaagtatactgggaagggctgggtttgtcatttgggagctgaatccacaccgtggtagtcggcagagggtgtggaggaccctctgggaacatttggggacccatattcagtttgaaatctgcccattcaaaactctttctgtattatatgagttgaaacgccacatccccctcctacaataggctgaatacaatattgaaaacaaagaaggagtgcaaaaaagtgatcaatacaaaaaaagtaaacatatcagttttaattgtcaagattattccagggcaagagttcatttccaatcacttctctccggttcttgttcctaagcggcccaagccaagatgatcattccagtttattttcaactttccgctggatcttccatgccctccccaatttggccgatgcagagggaggcgaccctgctgggttcacagcagcaaatcgtcgtttaagtccaacaaactagtcaatcttggtcggctggcaccgaacaaacccatctcgctctgggtccccaggtgcagaatcgatgtgtgttcttcaccaacgcacagaccgcttcttcactccagtgttcacttcctccagtcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccgtcgtcctcgcaaggtaagatctggaaatttttaattttctggtgatgacacagtgtgagtacaaatgcctttggattactctggctgtcacggaggagaaaaagcccatccacgagcccttgctgtttaatgatcctgtgggattcctccctggagatcctcccgtgaaaccagtgctgtgtcctgtgaatcactgtacttagggtagaagggtggaggggactttggctacctaggatgttcatccgtgtgcttcgcttcctccaggcgtggccctcctccagggctgcgctctgggcctctgccggattctctatcacgcgtcctgtttgcccagaaaaatccattgccacgagggagttctcggagacactgcgcactggcgtcgagaacggggacagcaaggccttcctctgctgagggattcggtaattctggtaaaggagcattccatacttgaggagtctgaacgctgtcatccagcacgtcctggtttgctcgtcctctgcacagagcaacctcagctctttagtttcattcctgactttgtttggctttatgcagagcccgtggtctgtaggggcgttgtactgcttcctgccagcgatcagggagaagatgttgctgtcctccaggtcggccagcagctgcaggtgtctgggttcctgcaaaagctgggtttgactgccatttgactgctggcaccaagtaaccatctgttctgggaagaaattcatgggatttttaaagaactcgtattttgcgtaattcttcctgaatagaaatttactctcactggccatggtactctccacctggaccaccagctcatggtcttccaagcacctctctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgctttgcggcggcctggctcggaggtaaagaacccggcgtgagcacaggggggctcccagggccacagagttcaggaaaaggattggggatggccggcagagatgaggttctaaactgctggtcttcctcctgaaggcgcctgacagcgaggatgtgcacaggctgggagcgctgcaccctctgcctcggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctcctggtgattcgcaagtcggtcagactgtgcggggagtcctggtcctgccgggtcttgttgactgcgaggtgtctgctccaccttgtcctggtagtacggatggtgcaaaaaggaatctgggcagccggctaaagccatgggttccttctgccttcttcaaattacattt

SEQ ID NO: 5 - DNA, 4780 bp, Homo sapiens
cgcaactttgcctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 6 - DNA, 4780 bp, Homo sapiens
tgaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccaatttacagtcactgcagtttgcactgtgacatcacaaatctaccgccagcttgcccgcccccagaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcgtcctggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagccgcccagcgcgaggccagcgagctggggccttaggaagtctgccgccacgtggaggcggtttacattctccaacaattcacttcggcagggaaaatacaaaagactacgtcaaaccagctacatacaaaactgtgaatcagagtcaagcttttgttctccttttaaataaacgcatatttataaatatgaaatactgcaaatacaagctgtctattggagagaggcgtgtgagagagagattatacactgatgggactggtctacgtacacagaaaaaagaaatcctagagttgtttttccttgaaaagggtttacctcgagccagtgaagaggaaggaatcgtggtgtaactgcaatgtccgtccctacagtgaagcctgccaccaggtgtgaacgtgagaattatcttactgtcaatagtttgaaagactgactggctgcgaaaggaagaaaatgcaattgagcactgatggttaaaaacatgttttgctagaaaattcttcatttgtatacctttcatggaaaacaactagagtgtggtctgtagactgacatacagtgttactatacggtagactgacttccagctgactggccttactgaagcttgtgacactgctctaggctacgggggttgactgaggagcagagaaatgctgttccttagggaacacttcagtggggcggatttggggcaatatcatggccagcacacattaatagaagccaggcaggtgttgtcttgaaaaaggaaatcattctgctcaccacagtagtttgtcgcctgtcaaaggagtcctttctgctttacagggatcaaaggtaaggaaatggccactctcacacctgatcactaagctaaggggacgtggcaaagggggccacccgaggggcggaggggaccaagtgacaactcaagccaccatctgactcatctcccggagcggggacaaagtgttgtgttgacaaaactcttccatgtccacaaccactgtgaggtacttctgaccctaagccagcagaggaggagcctctagctgctctgtgttcactggcttatgggggttttcagcaggacggagggctgcaagcaaagatctttaaatatcagcctgtgcctgtggcccctgcagcgtttccttgtctttatcactatggaaacccatgagacacagcacgaagacaaccaggtgccattttctctttagatcctttaatcccccgagggacatcagccgtgaaacgactcacaccactgcagcagcaggggtaaggcagtgatcgttctagaacaggctgaaggctgtggaaacgcaaggctgaagtacccaggtggattatgcagcatccaccgctggccgatgacgggtgccaggtgtgtctcaaggaggctggcccacgtcaatctagaggcgaggccattcagcctgctgtttgtggaacagtgaattttccaaaggaataaagtctcctgcactgtgcagaacaagacacactaataacaagaggatctgacatctgagcatagagaaatgattaacagactgtggttgcttgactgagtccacaaaatatgccaaatgcctaccacagtgacaccttttattttaacaagaaagcttttcaagtatactgggaagggctgggtttgtcatttgggagctgaatccacaccgtggtagtcggcagagggtgtggaggaccctctgggaacatttggggacccatattcagtttgaaatctgcccattcaaaactctttctgtattatatgagttgaaacgccacatccccctcctacaataggctgaatacaatattgaaaacaaagaaggagtgcaaaaaagtgatcaatacaaaaaaagtaaacatatcagttttaattgtcaagattattccagggcaagagttcatttccaatcacttctctccggttcttgttcctaagcggcccaagccaagatgatcattccagtttattttcaactttccgctggatcttccatgccctccccaatttggccgatgcagagggaggcgaccctgctgggttcacagcagcaaatcgtcgtttaagtccaacaaactagtcaatcttggtcggctggcaccgaacaaacccatctcgctctgggtccccaggtgcagaatcgatgtgtgttcttcaccaacgcacagaccgcttcttcactccagtgttcacttcctccagtcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccgtcgtcctcgcaaggtaagatctggaaatttttaattttctggtgatgacacagtgtgagtacaaatgcctttggattactctggctgtcacggaggagaaaaagcccatccacgagcccttgctgtttaatgatcctgtgggattcctccctggagatcctcccgtgaaaccagtgctgtgtcctgtgaatcactgtacttagggtagaagggtggaggggactttggctacctaggatgttcatccgtgtgcttcgcttcctccaggcgtggccctcctccagggctgcgctctgggcctctgccggattctctatcacgcgtcctgtttgcccagaaaaatccattgccacgagggagttctcggagacactgcgcactggcgtcgagaacggggacagcaaggccttcctctgctgagggattcggtaattctggtaaaggagcattccatacttgaggagtctgaacgctgtcatccagcacgtcctggtttgctcgtcctctgcacagagcaacctcagctctttagtttcattcctgactttgtttggctttatgcagagcccgtggtctgtaggggcgttgtactgcttcctgccagcgatcagggagaagatgttgctgtcctccaggtcggccagcagctgcaggtgtctgggttcctttgaagttcccttggtggagcaataaaggccagatctccgcaaacacacatacagctttttccatgatttctttcccagctctttcacatgcaaaaacccttgaatttcaggacaactactggagttcagaaaattctgcaaaagctgggtttgactgccatttgactgctggcaccaagtaaccatctgttctgggaagaaattcatgggatttttaaagaactcgtattttgcgtaattcttcctgaatagaaatttactctcactggccatggtactctccacctggaccaccagctcatggtcttccaagcacctctctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgctttgcggcggcctggctcggaggtaaagaacccggcgtgagcacaggggggctcccagggccacagagttcaggaaaaggattggggatggccggcagagatgaggttctaaactgctggtcttcctcctgaaggcgcctgacagcgaggatgtgcacaggctgggagcgctgcaccctctgcctcggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctcctggtgattcgcaagtcggtcagactgtgcggggagtcctggtcctgccgggtcttgttgactgcgaggtgtctgctccaccttgtcctgggagcaaacaggtttaggtctggtcaacgctgtgcttcacggaccactcacaatggggggaagcagagggtagcccaggggacagactccagcagggtcagctcacccacatctaccacttagaaggaggatgtttgttccctgggaggcaaagttgcg

SEQ ID NO: 7 - DNA, 5018 bp, Homo sapiens
gggaggaggcagagagggaagcgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 8 - DNA, 5018 bp, Homo sapiens
tgaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccaatttacagtcactgcagtttgcactgtgacatcacaaatctaccgccagcttgcccgcccccagaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcgtcctggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagccgcccagcgcgaggccagcgagctggggccttaggaagtctgccgccacgtggaggcggtttacattctccaacaattcacttcggcagggaaaatacaaaagactacgtcaaaccagctacatacaaaactgtgaatcagagtcaagcttttgttctccttttaaataaacgcatatttataaatatgaaatactgcaaatacaagctgtctattggagagaggcgtgtgagagagagattatacactgatgggactggtctacgtacacagaaaaaagaaatcctagagttgtttttccttgaaaagggtttacctcgagccagtgaagaggaaggaatcgtggtgtaactgcaatgtccgtccctacagtgaagcctgccaccaggtgtgaacgtgagaattatcttactgtcaatagtttgaaagactgactggctgcgaaaggaagaaaatgcaattgagcactgatggttaaaaacatgttttgctagaaaattcttcatttgtatacctttcatggaaaacaactagagtgtggtctgtagactgacatacagtgttactatacggtagactgacttccagctgactggccttactgaagcttgtgacactgctctaggctacgggggttgactgaggagcagagaaatgctgttccttagggaacacttcagtggggcggatttggggcaatatcatggccagcacacattaatagaagccaggcaggtgttgtcttgaaaaaggaaatcattctgctcaccacagtagtttgtcgcctgtcaaaggagtcctttctgctttacagggatcaaaggtaaggaaatggccactctcacacctgatcactaagctaaggggacgtggcaaagggggccacccgaggggcggaggggaccaagtgacaactcaagccaccatctgactcatctcccggagcggggacaaagtgttgtgttgacaaaactcttccatgtccacaaccactgtgaggtacttctgaccctaagccagcagaggaggagcctctagctgctctgtgttcactggcttatgggggttttcagcaggacggagggctgcaagcaaagatctttaaatatcagcctgtgcctgtggcccctgcagcgtttccttgtctttatcactatggaaacccatgagacacagcacgaagacaaccaggtgccattttctctttagatcctttaatcccccgagggacatcagccgtgaaacgactcacaccactgcagcagcaggggtaaggcagtgatcgttctagaacaggctgaaggctgtggaaacgcaaggctgaagtacccaggtggattatgcagcatccaccgctggccgatgacgggtgccaggtgtgtctcaaggaggctggcccacgtcaatctagaggcgaggccattcagcctgctgtttgtggaacagtgaattttccaaaggaataaagtctcctgcactgtgcagaacaagacacactaataacaagaggatctgacatctgagcatagagaaatgattaacagactgtggttgcttgactgagtccacaaaatatgccaaatgcctaccacagtgacaccttttattttaacaagaaagcttttcaagtatactgggaagggctgggtttgtcatttgggagctgaatccacaccgtggtagtcggcagagggtgtggaggaccctctgggaacatttggggacccatattcagtttgaaatctgcccattcaaaactctttctgtattatatgagttgaaacgccacatccccctcctacaataggctgaatacaatattgaaaacaaagaaggagtgcaaaaaagtgatcaatacaaaaaaagtaaacatatcagttttaattgtcaagattattccagggcaagagttcatttccaatcacttctctccggttcttgttcctaagcggcccaagccaagatgatcattccagtttattttcaactttccgctggatcttccatgccctccccaatttggccgatgcagagggaggcgaccctgctgggttcacagcagcaaatcgtcgtttaagtccaacaaactagtcaatcttggtcggctggcaccgaacaaacccatctcgctctgggtccccaggtgcagaatcgatgtgtgttcttcaccaacgcacagaccgcttcttcactccagtgttcacttcctccagtcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccgtcgtcctcgcaaggtaagatctggaaatttttaattttctggtgatgacacagtgtgagtacaaatgcctttggattactctggctgtcacggaggagaaaaagcccatccacgagcccttgctgtttaatgatcctgtgggattcctccctggagatcctcccgtgaaaccagtgctgtgtcctgtgaatcactgtacttagggtagaagggtggaggggactttggctacctaggatgttcatccgtgtgcttcgcttcctccaggcgtggccctcctccagggctgcgctctgggcctctgccggattctctatcacgcgtcctgtttgcccagaaaaatccattgccacgagggagttctcggagacactgcgcactggcgtcgagaacggggacagcaaggccttcctctgctgagggattcggtaattctggtaaaggagcattccatacttgaggagtctgaacgctgtcatccagcacgtcctggtttgctcgtcctctgcacagagcaacctcagctctttagtttcattcctgactttgtttggctttatgcagagcccgtggtctgtaggggcgttgtactgcttcctgccagcgatcagggagaagatgttgctgtcctccaggtcggccagcagctgcaggtgtctgggttcctttgaagttcccttggtggagcaataaaggccagatctccgcaaacacacatacagctttttccatgatttctttcccagctctttcacatgcaaaaacccttgaatttcaggacaactactggagttcagaaaattctgcaaaagctgggtttgactgccatttgactgctggcaccaagtaaccatctgttctgggaagaaattcatgggatttttaaagaactcgtattttgcgtaattcttcctgaatagaaatttactctcactggccatggtactctccacctggaccaccagctcatggtcttccaagcacctctctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgctttgcggcggcctggctcggaggtaaagaacccggcgtgagcacaggggggctcccagggccacagagttcaggaaaaggattggggatggccggcagagatgaggttctaaactgctggtcttcctcctgaaggcgcctgacagcgaggatgtgcacaggctgggagcgctgcaccctctgcctcggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctcctggtgattcgcaagtcggtcagactgtgcggggagtcctggtcctgccgggtcttgttgactgcgaggtgtctgctccaccttgtcctgtcaggagttggctctgtagcactgtctgctggggcggccaccctggcttcactgagaggacccaggtgaggacctggctgccggtcactgggctgctggtcactgagctaccagtcactgggcctgcagctgctgcttcctgctcagcattgtggtcagcgccaaagctgccgcgcgcggctccccgccgcctccgcgtggctgcgggcgacactcggcgtggccggcggcgggcgcgggtccccgcggggcgaggccggcgctcaagactgtcccgggcgccccgcgccgccggcgctgccgccacccaggggctgcgcggaaactttgggctccaccgggtctccgagcgccgagcccgcccggccgcagctcgcttccctctctgcctcctccc

SEQ ID NO: 9 - DNA, 5133 bp, Homo sapiens
agacgccggcggctcgcgggctgtggcgggggctgcggtcaaggccgcgctcctgggggccgccgcctgggagggtgggcgcccaggcgtccctgcagccccgggtgctccgactgcgcggcggggccgcggcgcgcgcgcccgggcgtccgggcgtccgggacagtggtgccagacactcccaaatcccgagccggcccagcctcgtacggaggaccttttttttggttctgttggtgacccgttagccgccgctggggcctaacaccaagttgagggctcgcggattagccgcccgccagccgtggaaatgtgataagagcggtaccgtttgcagaaggaaatttctgatgcaactcttcgcctttgctgattgcctctccaaacgcctgcctgacgactgccttggagcatgtgcgttatggaaattaggctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacagaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 10 - DNA, 5133 bp, Homo sapiens
tgaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccaatttacagtcactgcagtttgcactgtgacatcacaaatctaccgccagcttgcccgcccccagaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcgtcctggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagccgcccagcgcgaggccagcgagctggggccttaggaagtctgccgccacgtggaggcggtttacattctccaacaattcacttcggcagggaaaatacaaaagactacgtcaaaccagctacatacaaaactgtgaatcagagtcaagcttttgttctccttttaaataaacgcatatttataaatatgaaatactgcaaatacaagctgtctattggagagaggcgtgtgagagagagattatacactgatgggactggtctacgtacacagaaaaaagaaatcctagagttgtttttccttgaaaagggtttacctcgagccagtgaagaggaaggaatcgtggtgtaactgcaatgtccgtccctacagtgaagcctgccaccaggtgtgaacgtgagaattatcttactgtcaatagtttgaaagactgactggctgcgaaaggaagaaaatgcaattgagcactgatggttaaaaacatgttttgctagaaaattcttcatttgtatacctttcatggaaaacaactagagtgtggtctgtagactgacatacagtgttactatacggtagactgacttccagctgactggccttactgaagcttgtgacactgctctaggctacgggggttgactgaggagcagagaaatgctgttccttagggaacacttcagtggggcggatttggggcaatatcatggccagcacacattaatagaagccaggcaggtgttgtcttgaaaaaggaaatcattctgctcaccacagtagtttgtcgcctgtcaaaggagtcctttctgctttacagggatcaaaggtaaggaaatggccactctcacacctgatcactaagctaaggggacgtggcaaagggggccacccgaggggcggaggggaccaagtgacaactcaagccaccatctgactcatctcccggagcggggacaaagtgttgtgttgacaaaactcttccatgtccacaaccactgtgaggtacttctgaccctaagccagcagaggaggagcctctagctgctctgtgttcactggcttatgggggttttcagcaggacggagggctgcaagcaaagatctttaaatatcagcctgtgcctgtggcccctgcagcgtttccttgtctttatcactatggaaacccatgagacacagcacgaagacaaccaggtgccattttctctttagatcctttaatcccccgagggacatcagccgtgaaacgactcacaccactgcagcagcaggggtaaggcagtgatcgttctagaacaggctgaaggctgtggaaacgcaaggctgaagtacccaggtggattatgcagcatccaccgctggccgatgacgggtgccaggtgtgtctcaaggaggctggcccacgtcaatctagaggcgaggccattcagcctgctgtttgtggaacagtgaattttccaaaggaataaagtctcctgcactgtgcagaacaagacacactaataacaagaggatctgacatctgagcatagagaaatgattaacagactgtggttgcttgactgagtccacaaaatatgccaaatgcctaccacagtgacaccttttattttaacaagaaagcttttcaagtatactgggaagggctgggtttgtcatttgggagctgaatccacaccgtggtagtcggcagagggtgtggaggaccctctgggaacatttggggacccatattcagtttgaaatctgcccattcaaaactctttctgtattatatgagttgaaacgccacatccccctcctacaataggctgaatacaatattgaaaacaaagaaggagtgcaaaaaagtgatcaatacaaaaaaagtaaacatatcagttttaattgtcaagattattccagggcaagagttcatttccaatcacttctctccggttcttgttcctaagcggcccaagccaagatgatcattccagtttattttcaactttccgctggatcttccatgccctccccaatttggccgatgcagagggaggcgaccctgctgggttcacagcagcaaatcgtcgtttaagtccaacaaactagtcaatcttggtcggctggcaccgaacaaacccatctcgctctgggtccccaggtgcagaatcgatgtgtgttcttcaccaacgcacagaccgcttcttcactccagtgttcacttcctccagtcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccgtcgtcctcgcaaggtaagatctggaaatttttaattttctggtgatgacacagtgtgagtacaaatgcctttggattactctggctgtcacggaggagaaaaagcccatccacgagcccttgctgtttaatgatcctgtgggattcctccctggagatcctcccgtgaaaccagtgctgtgtcctgtgaatcactgtacttagggtagaagggtggaggggactttggctacctaggatgttcatccgtgtgcttcgcttcctccaggcgtggccctcctccagggctgcgctctgggcctctgccggattctctatcacgcgtcctgtttgcccagaaaaatccattgccacgagggagttctcggagacactgcgcactggcgtcgagaacggggacagcaaggccttcctctgctgagggattcggtaattctggtaaaggagcattccatacttgaggagtctgaacgctgtcatccagcacgtcctggtttgctcgtcctctgcacagagcaacctcagctctttagtttcattcctgactttgtttggctttatgcagagcccgtggtctgtaggggcgttgtactgcttcctgccagcgatcagggagaagatgttgctgtcctccaggtcggccagcagctgcaggtgtctgggttcctttgaagttcccttggtggagcaataaaggccagatctccgcaaacacacatacagctttttccatgatttctttcccagctctttcacatgcaaaaacccttgaatttcaggacaactactggagttcagaaaattctgcaaaagctgggtttgactgccatttgactgctggcaccaagtaaccatctgttctgggaagaaattcatgggatttttaaagaactcgtattttgcgtaattcttcctgaatagaaatttactctcactggccatggtactctccacctggaccaccagctcatggtcttccaagcacctctctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgctttgcggcggcctggctcggaggtaaagaacccggcgtgagcacaggggggctcccagggccacagagttcaggaaaaggattggggatggccggcagagatgaggttctaaactgctggtcttcctcctgaaggcgcctgacagcgaggatgtgcacaggctgggagcgctgcaccctctgcctcggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctctgtcaggagttggctctgtagcactgtctgctggggcggccaccctggcttcactgagaggacccaggtgaggacctggctgccggtcactgggctgctggtcactgagctaccagtcactgggcctgcagctgctgcttcctgctcagcattgtggtcagcgccaaagcctaatttccataacgcacatgctccaaggcagtcgtcaggcaggcgtttggagaggcaatcagcaaaggcgaagagttgcatcagaaatttccttctgcaaacggtaccgctcttatcacatttccacggctggcgggcggctaatccgcgagccctcaacttggtgttaggccccagcggcggctaacgggtcaccaacagaaccaaaaaaaaggtcctccgtacgaggctgggccggctcgggatttgggagtgtctggcaccactgtcccggacgcccggacgcccgggcgcgcgcgccgcggccccgccgcgcagtcggagcacccggggctgcagggacgcctgggcgcccaccctcccaggcggcggcccccaggagcgcggccttgaccgcagcccccgccacagcccgcgagccgccggcgtct

SEQ ID NO: 11 - DNA, 5336 bp, Homo sapiens
agacgccggcggctcgcgggctgtggcgggggctgcggtcaaggccgcgctcctgggggccgccgcctgggagggtgggcgcccaggcgtccctgcagccccgggtgctccgactgcgcggcggggccgcggcgcgcgcgcccgggcgtccgggcgtccgggacagtggtgccagacactcccaaatcccgagccggcccagcctcgtacggaggaccttttttttggttctgttggtgacccgttagccgccgctggggcctaacaccaagttgagggctcgcggattagccgcccgccagccgtggaaatgtgataagagcggtaccgtttgcagaaggaaatttctgatgcaactcttcgcctttgctgattgcctctccaaacgcctgcctgacgactgccttggagcatgtgcgttatggaaattaggctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggttctgaaaatattgtgcacagggcaggctgaggacacagccacgtgatacccactgtagagagagggagagagagacctcctatgcaagctgccggccctctgttccgtagtaaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttc

SEQ ID NO: 12 - DNA, 5336 bp, Homo sapiens
gaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccaatttacagtcactgcagtttgcactgtgacatcacaaatctaccgccagcttgcccgcccccagaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcgtcctggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagccgcccagcgcgaggccagcgagctggggccttaggaagtctgccgccacgtggaggcggtttacattctccaacaattcacttcggcagggaaaatacaaaagactacgtcaaaccagctacatacaaaactgtgaatcagagtcaagcttttgttctccttttaaataaacgcatatttataaatatgaaatactgcaaatacaagctgtctattggagagaggcgtgtgagagagagattatacactgatgggactggtctacgtacacagaaaaaagaaatcctagagttgtttttccttgaaaagggtttacctcgagccagtgaagaggaaggaatcgtggtgtaactgcaatgtccgtccctacagtgaagcctgccaccaggtgtgaacgtgagaattatcttactgtcaatagtttgaaagactgactggctgcgaaaggaagaaaatgcaattgagcactgatggttaaaaacatgttttgctagaaaattcttcatttgtatacctttcatggaaaacaactagagtgtggtctgtagactgacatacagtgttactatacggtagactgacttccagctgactggccttactgaagcttgtgacactgctctaggctacgggggttgactgaggagcagagaaatgctgttccttagggaacacttcagtggggcggatttggggcaatatcatggccagcacacattaatagaagccaggcaggtgttgtcttgaaaaaggaaatcattctgctcaccacagtagtttgtcgcctgtcaaaggagtcctttctgctttacagggatcaaaggtaaggaaatggccactctcacacctgatcactaagctaaggggacgtggcaaagggggccacccgaggggcggaggggaccaagtgacaactcaagccaccatctgactcatctcccggagcggggacaaagtgttgtgttgacaaaactcttccatgtccacaaccactgtgaggtacttctgaccctaagccagcagaggaggagcctctagctgctctgtgttcactggcttatgggggttttcagcaggacggagggctgcaagcaaagatctttaaatatcagcctgtgcctgtggcccctgcagcgtttccttgtctttatcactatggaaacccatgagacacagcacgaagacaaccaggtgccattttctctttagatcctttaatcccccgagggacatcagccgtgaaacgactcacaccactgcagcagcaggggtaaggcagtgatcgttctagaacaggctgaaggctgtggaaacgcaaggctgaagtacccaggtggattatgcagcatccaccgctggccgatgacgggtgccaggtgtgtctcaaggaggctggcccacgtcaatctagaggcgaggccattcagcctgctgtttgtggaacagtgaattttccaaaggaataaagtctcctgcactgtgcagaacaagacacactaataacaagaggatctgacatctgagcatagagaaatgattaacagactgtggttgcttgactgagtccacaaaatatgccaaatgcctaccacagtgacaccttttattttaacaagaaagcttttcaagtatactgggaagggctgggtttgtcatttgggagctgaatccacaccgtggtagtcggcagagggtgtggaggaccctctgggaacatttggggacccatattcagtttgaaatctgcccattcaaaactctttctgtattatatgagttgaaacgccacatccccctcctacaataggctgaatacaatattgaaaacaaagaaggagtgcaaaaaagtgatcaatacaaaaaaagtaaacatatcagttttaattgtcaagattattccagggcaagagttcatttccaatcacttctctccggttcttgttcctaagcggcccaagccaagatgatcattccagtttattttcaactttccgctggatcttccatgccctccccaatttggccgatgcagagggaggcgaccctgctgggttcacagcagcaaatcgtcgtttaagtccaacaaactagtcaatcttggtcggctggcaccgaacaaacccatctcgctctgggtccccaggtgcagaatcgatgtgtgttcttcaccaacgcacagaccgcttcttcactccagtgttcacttcctccagtcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccgtcgtcctcgcaaggtaagatctggaaatttttaattttctggtgatgacacagtgtgagtacaaatgcctttggattactctggctgtcacggaggagaaaaagcccatccacgagcccttgctgtttaatgatcctgtgggattcctccctggagatcctcccgtgaaaccagtgctgtgtcctgtgaatcactgtacttagggtagaagggtggaggggactttggctacctaggatgttcatccgtgtgcttcgcttcctccaggcgtggccctcctccagggctgcgctctgggcctctgccggattctctatcacgcgtcctgtttgcccagaaaaatccattgccacgagggagttctcggagacactgcgcactggcgtcgagaacggggacagcaaggccttcctctgctgagggattcggtaattctggtaaaggagcattccatacttgaggagtctgaacgctgtcatccagcacgtcctggtttgctcgtcctctgcacagagcaacctcagctctttagtttcattcctgactttgtttggctttatgcagagcccgtggtctgtaggggcgttgtactgcttcctgccagcgatcagggagaagatgttgctgtcctccaggtcggccagcagctgcaggtgtctgggttcctttgaagttcccttggtggagcaataaaggccagatctccgcaaacacacatacagctttttccatgatttctttcccagctctttcacatgcaaaaacccttgaatttcaggacaactactggagttcagaaaattctgcaaaagctgggtttgactgccatttgactgctggcaccaagtaaccatctgttctgggaagaaattcatgggatttttaaagaactcgtattttgcgtaattcttcctgaatagaaatttactctcactggccatggtactctccacctggaccaccagctcatggtcttccaagcacctctctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgctttgcggcggcctggctcggaggtaaagaacccggcgtgagcacaggggggctcccagggccacagagttcaggaaaaggattggggatggccggcagagatgaggttctaaactgctggtcttcctcctgaaggcgcctgacagcgaggatgtgcacaggctgggagcgctgcaccctctgcctcggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctcctggtgattcgcaagtcggtcagactgtgcggggagtcctggtcctgccgggtcttgttgactgcgaggtgtctgctccaccttgtccttactacggaacagagggccggcagcttgcataggaggtctctctctccctctctctacagtgggtatcacgtggctgtgtcctcagcctgccctgtgcacaatattttcagaacctgtcaggagttggctctgtagcactgtctgctggggcggccaccctggcttcactgagaggacccaggtgaggacctggctgccggtcactgggctgctggtcactgagctaccagtcactgggcctgcagctgctgcttcctgctcagcattgtggtcagcgccaaagcctaatttccataacgcacatgctccaaggcagtcgtcaggcaggcgtttggagaggcaatcagcaaaggcgaagagttgcatcagaaatttccttctgcaaacggtaccgctcttatcacatttccacggctggcgggcggctaatccgcgagccctcaacttggtgttaggccccagcggcggctaacgggtcaccaacagaaccaaaaaaaaggtcctccgtacgaggctgggccggctcgggatttgggagtgtctggcaccactgtcccggacgcccggacgcccgggcgcgcgcgccgcggccccgccgcgcagtcggagcacccggggctgcagggacgcctgggcgcccaccctcccaggcggcggcccccaggagcgcggccttgaccgcagcccccgccacagcccgcgagccgccggcgtct

SEQ ID NO: 13 - DNA, 4857 bp, Homo sapiens
gggaggaggcagagagggaagcgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcaggtgctgcagcgcagtaaatgtaatttgaagaaggcagaaggaacccatggctttagccggctgcccagattcctttttgcaccatccgtactaccagaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 14 - DNA, 4857 bp, Homo sapiens
tgaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccaatttacagtcactgcagtttgcactgtgacatcacaaatctaccgccagcttgcccgcccccagaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcgtcctggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagccgcccagcgcgaggccagcgagctggggccttaggaagtctgccgccacgtggaggcggtttacattctccaacaattcacttcggcagggaaaatacaaaagactacgtcaaaccagctacatacaaaactgtgaatcagagtcaagcttttgttctccttttaaataaacgcatatttataaatatgaaatactgcaaatacaagctgtctattggagagaggcgtgtgagagagagattatacactgatgggactggtctacgtacacagaaaaaagaaatcctagagttgtttttccttgaaaagggtttacctcgagccagtgaagaggaaggaatcgtggtgtaactgcaatgtccgtccctacagtgaagcctgccaccaggtgtgaacgtgagaattatcttactgtcaatagtttgaaagactgactggctgcgaaaggaagaaaatgcaattgagcactgatggttaaaaacatgttttgctagaaaattcttcatttgtatacctttcatggaaaacaactagagtgtggtctgtagactgacatacagtgttactatacggtagactgacttccagctgactggccttactgaagcttgtgacactgctctaggctacgggggttgactgaggagcagagaaatgctgttccttagggaacacttcagtggggcggatttggggcaatatcatggccagcacacattaatagaagccaggcaggtgttgtcttgaaaaaggaaatcattctgctcaccacagtagtttgtcgcctgtcaaaggagtcctttctgctttacagggatcaaaggtaaggaaatggccactctcacacctgatcactaagctaaggggacgtggcaaagggggccacccgaggggcggaggggaccaagtgacaactcaagccaccatctgactcatctcccggagcggggacaaagtgttgtgttgacaaaactcttccatgtccacaaccactgtgaggtacttctgaccctaagccagcagaggaggagcctctagctgctctgtgttcactggcttatgggggttttcagcaggacggagggctgcaagcaaagatctttaaatatcagcctgtgcctgtggcccctgcagcgtttccttgtctttatcactatggaaacccatgagacacagcacgaagacaaccaggtgccattttctctttagatcctttaatcccccgagggacatcagccgtgaaacgactcacaccactgcagcagcaggggtaaggcagtgatcgttctagaacaggctgaaggctgtggaaacgcaaggctgaagtacccaggtggattatgcagcatccaccgctggccgatgacgggtgccaggtgtgtctcaaggaggctggcccacgtcaatctagaggcgaggccattcagcctgctgtttgtggaacagtgaattttccaaaggaataaagtctcctgcactgtgcagaacaagacacactaataacaagaggatctgacatctgagcatagagaaatgattaacagactgtggttgcttgactgagtccacaaaatatgccaaatgcctaccacagtgacaccttttattttaacaagaaagcttttcaagtatactgggaagggctgggtttgtcatttgggagctgaatccacaccgtggtagtcggcagagggtgtggaggaccctctgggaacatttggggacccatattcagtttgaaatctgcccattcaaaactctttctgtattatatgagttgaaacgccacatccccctcctacaataggctgaatacaatattgaaaacaaagaaggagtgcaaaaaagtgatcaatacaaaaaaagtaaacatatcagttttaattgtcaagattattccagggcaagagttcatttccaatcacttctctccggttcttgttcctaagcggcccaagccaagatgatcattccagtttattttcaactttccgctggatcttccatgccctccccaatttggccgatgcagagggaggcgaccctgctgggttcacagcagcaaatcgtcgtttaagtccaacaaactagtcaatcttggtcggctggcaccgaacaaacccatctcgctctgggtccccaggtgcagaatcgatgtgtgttcttcaccaacgcacagaccgcttcttcactccagtgttcacttcctccagtcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccgtcgtcctcgcaaggtaagatctggaaatttttaattttctggtgatgacacagtgtgagtacaaatgcctttggattactctggctgtcacggaggagaaaaagcccatccacgagcccttgctgtttaatgatcctgtgggattcctccctggagatcctcccgtgaaaccagtgctgtgtcctgtgaatcactgtacttagggtagaagggtggaggggactttggctacctaggatgttcatccgtgtgcttcgcttcctccaggcgtggccctcctccagggctgcgctctgggcctctgccggattctctatcacgcgtcctgtttgcccagaaaaatccattgccacgagggagttctcggagacactgcgcactggcgtcgagaacggggacagcaaggccttcctctgctgagggattcggtaattctggtaaaggagcattccatacttgaggagtctgaacgctgtcatccagcacgtcctggtttgctcgtcctctgcacagagcaacctcagctctttagtttcattcctgactttgtttggctttatgcagagcccgtggtctgtaggggcgttgtactgcttcctgccagcgatcagggagaagatgttgctgtcctccaggtcggccagcagctgcaggtgtctgggttcctttgaagttcccttggtggagcaataaaggccagatctccgcaaacacacatacagctttttccatgatttctttcccagctctttcacatgcaaaaacccttgaatttcaggacaactactggagttcagaaaattctgcaaaagctgggtttgactgccatttgactgctggcaccaagtaaccatctgttctgggaagaaattcatgggatttttaaagaactcgtattttgcgtaattcttcctgaatagaaatttactctcactggccatggtactctccacctggaccaccagctcatggtcttccaagcacctctctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgctttgcggcggcctggctcggaggtaaagaacccggcgtgagcacaggggggctcccagggccacagagttcaggaaaaggattggggatggccggcagagatgaggttctaaactgctggtcttcctcctgaaggcgcctgacagcgaggatgtgcacaggctgggagcgctgcaccctctgcctcggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctctggtagtacggatggtgcaaaaaggaatctgggcagccggctaaagccatgggttccttctgccttcttcaaattacatttactgcgctgcagcacctgccgcgcgcggctccccgccgcctccgcgtggctgcgggcgacactcggcgtggccggcggcgggcgcgggtccccgcggggcgaggccggcgctcaagactgtcccgggcgccccgcgccgccggcgctgccgccacccaggggctgcgcggaaactttgggctccaccgggtctccgagcgccgagcccgcccggccgcagctcgcttccctctctgcctcctccc

SEQ ID NO: 15 - DNA, 5173 bp, Homo sapiens
gggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacagaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 16 - DNA, 5173 bp, Homo sapiens
tgaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccaatttacagtcactgcagtttgcactgtgacatcacaaatctaccgccagcttgcccgcccccagaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcgtcctggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagccgcccagcgcgaggccagcgagctggggccttaggaagtctgccgccacgtggaggcggtttacattctccaacaattcacttcggcagggaaaatacaaaagactacgtcaaaccagctacatacaaaactgtgaatcagagtcaagcttttgttctccttttaaataaacgcatatttataaatatgaaatactgcaaatacaagctgtctattggagagaggcgtgtgagagagagattatacactgatgggactggtctacgtacacagaaaaaagaaatcctagagttgtttttccttgaaaagggtttacctcgagccagtgaagaggaaggaatcgtggtgtaactgcaatgtccgtccctacagtgaagcctgccaccaggtgtgaacgtgagaattatcttactgtcaatagtttgaaagactgactggctgcgaaaggaagaaaatgcaattgagcactgatggttaaaaacatgttttgctagaaaattcttcatttgtatacctttcatggaaaacaactagagtgtggtctgtagactgacatacagtgttactatacggtagactgacttccagctgactggccttactgaagcttgtgacactgctctaggctacgggggttgactgaggagcagagaaatgctgttccttagggaacacttcagtggggcggatttggggcaatatcatggccagcacacattaatagaagccaggcaggtgttgtcttgaaaaaggaaatcattctgctcaccacagtagtttgtcgcctgtcaaaggagtcctttctgctttacagggatcaaaggtaaggaaatggccactctcacacctgatcactaagctaaggggacgtggcaaagggggccacccgaggggcggaggggaccaagtgacaactcaagccaccatctgactcatctcccggagcggggacaaagtgttgtgttgacaaaactcttccatgtccacaaccactgtgaggtacttctgaccctaagccagcagaggaggagcctctagctgctctgtgttcactggcttatgggggttttcagcaggacggagggctgcaagcaaagatctttaaatatcagcctgtgcctgtggcccctgcagcgtttccttgtctttatcactatggaaacccatgagacacagcacgaagacaaccaggtgccattttctctttagatcctttaatcccccgagggacatcagccgtgaaacgactcacaccactgcagcagcaggggtaaggcagtgatcgttctagaacaggctgaaggctgtggaaacgcaaggctgaagtacccaggtggattatgcagcatccaccgctggccgatgacgggtgccaggtgtgtctcaaggaggctggcccacgtcaatctagaggcgaggccattcagcctgctgtttgtggaacagtgaattttccaaaggaataaagtctcctgcactgtgcagaacaagacacactaataacaagaggatctgacatctgagcatagagaaatgattaacagactgtggttgcttgactgagtccacaaaatatgccaaatgcctaccacagtgacaccttttattttaacaagaaagcttttcaagtatactgggaagggctgggtttgtcatttgggagctgaatccacaccgtggtagtcggcagagggtgtggaggaccctctgggaacatttggggacccatattcagtttgaaatctgcccattcaaaactctttctgtattatatgagttgaaacgccacatccccctcctacaataggctgaatacaatattgaaaacaaagaaggagtgcaaaaaagtgatcaatacaaaaaaagtaaacatatcagttttaattgtcaagattattccagggcaagagttcatttccaatcacttctctccggttcttgttcctaagcggcccaagccaagatgatcattccagtttattttcaactttccgctggatcttccatgccctccccaatttggccgatgcagagggaggcgaccctgctgggttcacagcagcaaatcgtcgtttaagtccaacaaactagtcaatcttggtcggctggcaccgaacaaacccatctcgctctgggtccccaggtgcagaatcgatgtgtgttcttcaccaacgcacagaccgcttcttcactccagtgttcacttcctccagtcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccgtcgtcctcgcaaggtaagatctggaaatttttaattttctggtgatgacacagtgtgagtacaaatgcctttggattactctggctgtcacggaggagaaaaagcccatccacgagcccttgctgtttaatgatcctgtgggattcctccctggagatcctcccgtgaaaccagtgctgtgtcctgtgaatcactgtacttagggtagaagggtggaggggactttggctacctaggatgttcatccgtgtgcttcgcttcctccaggcgtggccctcctccagggctgcgctctgggcctctgccggattctctatcacgcgtcctgtttgcccagaaaaatccattgccacgagggagttctcggagacactgcgcactggcgtcgagaacggggacagcaaggccttcctctgctgagggattcggtaattctggtaaaggagcattccatacttgaggagtctgaacgctgtcatccagcacgtcctggtttgctcgtcctctgcacagagcaacctcagctctttagtttcattcctgactttgtttggctttatgcagagcccgtggtctgtaggggcgttgtactgcttcctgccagcgatcagggagaagatgttgctgtcctccaggtcggccagcagctgcaggtgtctgggttcctttgaagttcccttggtggagcaataaaggccagatctccgcaaacacacatacagctttttccatgatttctttcccagctctttcacatgcaaaaacccttgaatttcaggacaactactggagttcagaaaattctgcaaaagctgggtttgactgccatttgactgctggcaccaagtaaccatctgttctgggaagaaattcatgggatttttaaagaactcgtattttgcgtaattcttcctgaatagaaatttactctcactggccatggtactctccacctggaccaccagctcatggtcttccaagcacctctctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgctttgcggcggcctggctcggaggtaaagaacccggcgtgagcacaggggggctcccagggccacagagttcaggaaaaggattggggatggccggcagagatgaggttctaaactgctggtcttcctcctgaaggcgcctgacagcgaggatgtgcacaggctgggagcgctgcaccctctgcctcggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctctgtcaggagttggctctgtagcactgtctgctggggcggccaccctggcttcactgagaggacccaggtgaggacctggctgccggtcactgggctgctggtcactgagctaccagtcactgggcctgcagctgctgcttcctgctcagcattgtggtcagcgccaaagctggagagcgggcggcagcactggccgcacggggtcgctgcgtgtgcgccgccggcccgggtagggcttcggggcccggcccccgcagtgcccggcgcgtggacagcgctccgcatggacagcgctcggagccgggccgggctggtcctccacggctccgccccggccaggggcctgcggcgcagaaaaccgacccggggcctcggggccaccgcgcgccaggcgaacgcgctagcacgaaaagcgggccaacgccgcctctggggacgccatccgggcgagggtgggatgccgcgccaccgcccgagcgtgcccgggggctcccagcgccatcaccacgcaggtgcccgggggcccctccgcggagccggctgccgcccggctgcaatactcagcctccgagggactgggcgctcctgaggagcgggaggacgacggagcagcgcccggtcctggagcacaacaggaatccc

SEQ ID NO: 17 - DNA, 5089 bp, Mus musculus
atcgagggggtggggtgcggggaggcggcaggaagggaagggcgctgcgaccagtggcgggcgggattcgcgttccgagacccacgggagcacgaagtttccgcgcaccgtctcacgcacggcgactgggaccgtccagtgtccggctttgccttcggtttttctccgttgtgactcgtgcaacgtgtggccagcggccacgcggaggcgacgaggagctgcacgtcaggacaaagtggggcagtcaacgtccaaacccgaaaacctagctaagtctgggttttcgccacaacaaagaagccaaccagagcatggtcttgggcttcaagtactaatgaacaacgatattaactcgtccgtggaaagccttaactcagcttgcaacatgcagtctgatactgatactgcaccacttcttgaggatggccagcatgccagcaaccagggagcagcatctagctcccggggacagccacaggcgtccccgaggcagaaaatgcaacgctcgcagcctgtgcacattctcaggcgccttcaggaggaagaccagcagttaagaactgcatctcttccggccatccccaacccatttccggagctcactggtgcggcccctgggagccctccttcggttgctcctagctccttacctcctcctccgagccagccacctgccaagcatttccctccaggctttcagctgtcgaaactcacccgtccaggtctgtggacaaagaccactgcgagattttcaaagaaacaacctaagaaccagtgtccaaccgacactgtgaatccagtggcacggatgcccacttcacagatggagaagctgaggctcagaaaggatgtcaaagtctttagtgaagatgggaccagcaaagtggtggagattctaaccgacatgacagccagggacctgtgccagctgctggtttacaaaagtcactgtgtggatgacaacagctggactctggtggaacaccacccacaactgggattagagaggtgcctggaggaccatgagatcgtggtccaagtggagagtaccatgccaagtgagagcaaattcttattcagaaagaattatgcgaagtacgagttctttaagaatccagtgaacttcttcccggatcagatggtcaattggtgccagcagtccaacggtggccaggcgcagcttctgcagaattttctgaacaccagcagctgccctgagatccaggggttcttgcaggtgaaagaggtaggacgcaagtcttggaagaagctgtatgtgtgcctgcgcagatctggcctctattactccaccaaggggacttcaaaagaacccagacacctgcagctgctggctgacctggaagaaagcagcatcttctacctgattgctggaaagaagcagtacaacgcgccgaatgaacatgggatgtgcatcaagccaaacaaagcgaagaccgagatgaaggagcttcgtctgctctgtgccgaagatgagcagatccgtacttgctggatgactgccttcagactgctcaagtacggaatgctcctgtaccaaaactatcgcatcccacagaggaagggtctgccccctcctttcaacgcacctatgcgcagtgtttctgagaattctcttgtggccatggatttttctggacaaatcggaagagtgatcgataacccggctgaagcccagagtgctgccctggaagagggccatgcctggcgtaagcggagcacacggatgaatatcctaagcagccaaagcccactgcatccttctaccctgaatgcagtgattcacaggactcagcattggttccatggacgtatctcccgcgaggagtctcacaggatcatcaagcaacaaggtctcgtggacgggctgttcctccttcgtgacagccagagtaatccaaaggcgttcgtactgacactgtgccatcaccagaagattaaaaacttccagatcttaccttgcgaggatgatgggcagaccttcttcactctggatgatgggaacaccaagttctccgatctgatccagctggtcgacttctaccagctcaacaaaggtgttctgccctgcaagctgaaacaccactgcatccgcgtggccttatgacctccttgcccactcacagaggctggaggcagcgacactggaacggagaagagagatctgcatgagggtgagaacacacacctactcccacccaaggactcagaacaacatggctttttgatcggtaccaaccgacctacatcaattagttattggacttcacaaagatttgccgctgtggatcaaacaggaccacctccctctgcgtcagccatttaaaattgggggagggaagagatccagtgcaagtgtgggaagaaactggaatgacgattttgattaggccacgtagggtgaaaaccgcagaaaaatgattggaaatgaactcttgccctggaataaccttgacaattcaaaccgcgatgtttactttttgtattgatcacttttttgcactccttcttcgttgtcgatgttgtactcagcctatggtaggagaggatgtggctttgcaactcagatcagacaaagaatttttgaattggcaggctttagcctacaaatgggtcccccaagttttctagataacatcctgctctctgcaggttgcggcagtgtgggtttggctccagtccttcccattatacttgaaaagctttttttttttttttaaataaaataataagataaaaggtgacaaccgcagttgacacctagcatgttttgtggacgcagtcaagctgccacagtctggtcatcgttgttgttgtgctgacgtctggtcatgtattattagtgtgtctcgttctccacggtgctggagacctcattactttggaaaactcactgttccccagcacagcacagctgcatgacctcagcttcagactgatgtcagccagccttcttggaacacattgctattcattgtggatgccacacagtccatctggggtgccctgtgcctcccattttcacagccgcccactgttgtagaataatcgctgcctttaccctctgcagtaccctcagtcatttcacttctcccacaggggtggggtaggggtggggttaaaggatcgaaagagaaaaaaacgccaacttgttggccttgtgctctgtcactctgagcatctatggtgataaagagaaggaaacgctgcagaggcacaagcataagctggctttgagtctttgaaagcttgatggcctctgcaccctactgaaaaccccctaagccagcaggagcagggtatgcagaggctttgcctctgctggcttagggtgagaagtacctcacaatggatgtgaacattggacagattttaggagcatgatgtttgcctcctccgagagagaggagtcagagagagagaggagtcagaaggtggccggagttatcattgggtcccctgagctccatgaaggaccctctgttgtccccttgatgatttatcaggcatgagagtagcagacaggattgccttgagaaacacacagacaacaacggtggtgaacacatttccctttcttgataccacccagaaagtctgctacatacctgagttagccactagattgcctgtcccgactcattgaagtgctccccagggagccacttctgatttgccatggttgacagcatagtggaagatagatatgacagcgctttgtaaagcaggccagtggcaagctggcccacagtagagaaacactgtagttcacagaccatgcaaccgtgtttccacgagatgttattacaacaaatgaagaatttttttccttttttttcattttaatcttttttgacttttttttagttaaccattttttatgcataagtgctcaaatgcatttctctttctttcgaaactagttaatcgttaagttgacaatgagagaattctcaagttcatacctggcagcaggctcccactgatcttccccttacagacagataacagacatttcagttttaccgtgctcatttctttttgctgacttaaggtcagaacttttacagacaacaaacaaccctagggtttctttttccagtttacacagaccggtccccacagtgcagaatccatttctctttcgtctcaacagtagacaactaggatgtggatctcatatttataagtatgcattttatttaagaggaagtataggcttgactctggttcacaatttcgtacgtagctggtttgacgtagaactttgtacttcccttgccgaagtgaattgttgaaggctgcaacccacccaccttgagtgtagcagacttcagtggccccgagatcgccagccctttgcacaggcagctgggaattccacctgaaacagctggtccctaggttagcgggttcccagcccccctaatcagagactgaaggacaattgacttttatttttgtatttaattgacatgaatgtaaaggggacagctcagggttgttttggagcctgtttgactttgtaatctctgcctgtgattttcttttctaaatgacgactccgtgtaaccacctggactaagttgagaaggaaactgccaaatgctttgggtttttagggttttaataggtagactctgttctattattaggtgttaagagtttccaaacgtgttttcttttttcttttattgtttgcttaaactttgaagaaatatgtgcctcagcttagatgttttgtcttcccctttctgcacttaaatacctgacagcctgttcgatcgctgtgcctccgagggcgcttctagctcatcgtagatttgtgatgtcatagtgcaaactgcagtgaccggtaaaatgacctgacatgtaaccgttttcagggaatgcagagggtgttaactaatagacaaaacctttatcccgcgtgctttgcttcaccttgtgctatatagctctttggctcgtgaacctaattgtaaactttcaggtatttttgtacaaataagggactgatgttctgtttcttgttattagaaataaacattaataaagcgttcttggtgtc

SEQ ID NO: 18 - DNA, 5089 bp, Mus musculus
gacaccaagaacgctttattaatgtttatttctaataacaagaaacagaacatcagtcccttatttgtacaaaaatacctgaaagtttacaattaggttcacgagccaaagagctatatagcacaaggtgaagcaaagcacgcgggataaaggttttgtctattagttaacaccctctgcattccctgaaaacggttacatgtcaggtcattttaccggtcactgcagtttgcactatgacatcacaaatctacgatgagctagaagcgccctcggaggcacagcgatcgaacaggctgtcaggtatttaagtgcagaaaggggaagacaaaacatctaagctgaggcacatatttcttcaaagtttaagcaaacaataaaagaaaaaagaaaacacgtttggaaactcttaacacctaataatagaacagagtctacctattaaaaccctaaaaacccaaagcatttggcagtttccttctcaacttagtccaggtggttacacggagtcgtcatttagaaaagaaaatcacaggcagagattacaaagtcaaacaggctccaaaacaaccctgagctgtcccctttacattcatgtcaattaaatacaaaaataaaagtcaattgtccttcagtctctgattaggggggctgggaacccgctaacctagggaccagctgtttcaggtggaattcccagctgcctgtgcaaagggctggcgatctcggggccactgaagtctgctacactcaaggtgggtgggttgcagccttcaacaattcacttcggcaagggaagtacaaagttctacgtcaaaccagctacgtacgaaattgtgaaccagagtcaagcctatacttcctcttaaataaaatgcatacttataaatatgagatccacatcctagttgtctactgttgagacgaaagagaaatggattctgcactgtggggaccggtctgtgtaaactggaaaaagaaaccctagggttgtttgttgtctgtaaaagttctgaccttaagtcagcaaaaagaaatgagcacggtaaaactgaaatgtctgttatctgtctgtaaggggaagatcagtgggagcctgctgccaggtatgaacttgagaattctctcattgtcaacttaacgattaactagtttcgaaagaaagagaaatgcatttgagcacttatgcataaaaaatggttaactaaaaaaaagtcaaaaaagattaaaatgaaaaaaaaggaaaaaaattcttcatttgttgtaataacatctcgtggaaacacggttgcatggtctgtgaactacagtgtttctctactgtgggccagcttgccactggcctgctttacaaagcgctgtcatatctatcttccactatgctgtcaaccatggcaaatcagaagtggctccctggggagcacttcaatgagtcgggacaggcaatctagtggctaactcaggtatgtagcagactttctgggtggtatcaagaaagggaaatgtgttcaccaccgttgttgtctgtgtgtttctcaaggcaatcctgtctgctactctcatgcctgataaatcatcaaggggacaacagagggtccttcatggagctcaggggacccaatgataactccggccaccttctgactcctctctctctctgactcctctctctcggaggaggcaaacatcatgctcctaaaatctgtccaatgttcacatccattgtgaggtacttctcaccctaagccagcagaggcaaagcctctgcataccctgctcctgctggcttagggggttttcagtagggtgcagaggccatcaagctttcaaagactcaaagccagcttatgcttgtgcctctgcagcgtttccttctctttatcaccatagatgctcagagtgacagagcacaaggccaacaagttggcgtttttttctctttcgatcctttaaccccacccctaccccacccctgtgggagaagtgaaatgactgagggtactgcagagggtaaaggcagcgattattctacaacagtgggcggctgtgaaaatgggaggcacagggcaccccagatggactgtgtggcatccacaatgaatagcaatgtgttccaagaaggctggctgacatcagtctgaagctgaggtcatgcagctgtgctgtgctggggaacagtgagttttccaaagtaatgaggtctccagcaccgtggagaacgagacacactaataatacatgaccagacgtcagcacaacaacaacgatgaccagactgtggcagcttgactgcgtccacaaaacatgctaggtgtcaactgcggttgtcaccttttatcttattattttatttaaaaaaaaaaaaaaagcttttcaagtataatgggaaggactggagccaaacccacactgccgcaacctgcagagagcaggatgttatctagaaaacttgggggacccatttgtaggctaaagcctgccaattcaaaaattctttgtctgatctgagttgcaaagccacatcctctcctaccataggctgagtacaacatcgacaacgaagaaggagtgcaaaaaagtgatcaatacaaaaagtaaacatcgcggtttgaattgtcaaggttattccagggcaagagttcatttccaatcatttttctgcggttttcaccctacgtggcctaatcaaaatcgtcattccagtttcttcccacacttgcactggatctcttccctcccccaattttaaatggctgacgcagagggaggtggtcctgtttgatccacagcggcaaatctttgtgaagtccaataactaattgatgtaggtcggttggtaccgatcaaaaagccatgttgttctgagtccttgggtgggagtaggtgtgtgttctcaccctcatgcagatctctcttctccgttccagtgtcgctgcctccagcctctgtgagtgggcaaggaggtcataaggccacgcggatgcagtggtgtttcagcttgcagggcagaacacctttgttgagctggtagaagtcgaccagctggatcagatcggagaacttggtgttcccatcatccagagtgaagaaggtctgcccatcatcctcgcaaggtaagatctggaagtttttaatcttctggtgatggcacagtgtcagtacgaacgcctttggattactctggctgtcacgaaggaggaacagcccgtccacgagaccttgttgcttgatgatcctgtgagactcctcgcgggagatacgtccatggaaccaatgctgagtcctgtgaatcactgcattcagggtagaaggatgcagtgggctttggctgcttaggatattcatccgtgtgctccgcttacgccaggcatggccctcttccagggcagcactctgggcttcagccgggttatcgatcactcttccgatttgtccagaaaaatccatggccacaagagaattctcagaaacactgcgcataggtgcgttgaaaggagggggcagacccttcctctgtgggatgcgatagttttggtacaggagcattccgtacttgagcagtctgaaggcagtcatccagcaagtacggatctgctcatcttcggcacagagcagacgaagctccttcatctcggtcttcgctttgtttggcttgatgcacatcccatgttcattcggcgcgttgtactgcttctttccagcaatcaggtagaagatgctgctttcttccaggtcagccagcagctgcaggtgtctgggttcttttgaagtccccttggtggagtaatagaggccagatctgcgcaggcacacatacagcttcttccaagacttgcgtcctacctctttcacctgcaagaacccctggatctcagggcagctgctggtgttcagaaaattctgcagaagctgcgcctggccaccgttggactgctggcaccaattgaccatctgatccgggaagaagttcactggattcttaaagaactcgtacttcgcataattctttctgaataagaatttgctctcacttggcatggtactctccacttggaccacgatctcatggtcctccaggcacctctctaatcccagttgtgggtggtgttccaccagagtccagctgttgtcatccacacagtgacttttgtaaaccagcagctggcacaggtccctggctgtcatgtcggttagaatctccaccactttgctggtcccatcttcactaaagactttgacatcctttctgagcctcagcttctccatctgtgaagtgggcatccgtgccactggattcacagtgtcggttggacactggttcttaggttgtttctttgaaaatctcgcagtggtctttgtccacagacctggacgggtgagtttcgacagctgaaagcctggagggaaatgcttggcaggtggctggctcggaggaggaggtaaggagctaggagcaaccgaaggagggctcccaggggccgcaccagtgagctccggaaatgggttggggatggccggaagagatgcagttcttaactgctggtcttcctcctgaaggcgcctgagaatgtgcacaggctgcgagcgttgcattttctgcctcggggacgcctgtggctgtccccgggagctagatgctgctccctggttgctggcatgctggccatcctcaagaagtggtgcagtatcagtatcagactgcatgttgcaagctgagttaaggctttccacggacgagttaatatcgttgttcattagtacttgaagcccaagaccatgctctggttggcttctttgttgtggcgaaaacccagacttagctaggttttcgggtttggacgttgactgccccactttgtcctgacgtgcagctcctcgtcgcctccgcgtggccgctggccacacgttgcacgagtcacaacggagaaaaaccgaaggcaaagccggacactggacggtcccagtcgccgtgcgtgagacggtgcgcggaaacttcgtgctcccgtgggtctcggaacgcgaatcccgcccgccactggtcgcagcgcccttcccttcctgccgcctccccgcaccccaccccctcgat

SEQ ID NO: 19 - DNA, 4764 bp, Mus musculus
atcgccatctacagtttctgtctgttagaggagagtgtgaaatctactgcgtcctagctctgtaccttggacaaagtggggcagtcaacgtccaaacccgaaaacctagctaagtctgggttttcgccacaacaaagaagccaaccagagcatggtcttgggcttcaagtactaatgaacaacgatattaactcgtccgtggaaagccttaactcagcttgcaacatgcagtctgatactgatactgcaccacttcttgaggatggccagcatgccagcaaccagggagcagcatctagctcccggggacagccacaggcgtccccgaggcagaaaatgcaacgctcgcagcctgtgcacattctcaggcgccttcaggaggaagaccagcagttaagaactgcatctcttccggccatccccaacccatttccggagctcactggtgcggcccctgggagccctccttcggttgctcctagctccttacctcctcctccgagccagccacctgccaagcatgatgtcaaagtctttagtgaagatgggaccagcaaagtggtggagattctaaccgacatgacagccagggacctgtgccagctgctggtttacaaaagtcactgtgtggatgacaacagctggactctggtggaacaccacccacaactgggattagagaggtgcctggaggaccatgagatcgtggtccaagtggagagtaccatgccaagtgagagcaaattcttattcagaaagaattatgcgaagtacgagttctttaagaatccagtgaacttcttcccggatcagatggtcaattggtgccagcagtccaacggtggccaggcgcagcttctgcagaattttctgaacaccagcagctgccctgagatccaggggttcttgcaggtgaaagaggtaggacgcaagtcttggaagaagctgtatgtgtgcctgcgcagatctggcctctattactccaccaaggggacttcaaaagaacccagacacctgcagctgctggctgacctggaagaaagcagcatcttctacctgattgctggaaagaagcagtacaacgcgccgaatgaacatgggatgtgcatcaagccaaacaaagcgaagaccgagatgaaggagcttcgtctgctctgtgccgaagatgagcagatccgtacttgctggatgactgccttcagactgctcaagtacggaatgctcctgtaccaaaactatcgcatcccacagaggaagggtctgccccctcctttcaacgcacctatgcgcagtgtttctgagaattctcttgtggccatggatttttctggacaaatcggaagagtgatcgataacccggctgaagcccagagtgctgccctggaagagggccatgcctggcgtaagcggagcacacggatgaatatcctaagcagccaaagcccactgcatccttctaccctgaatgcagtgattcacaggactcagcattggttccatggacgtatctcccgcgaggagtctcacaggatcatcaagcaacaaggtctcgtggacgggctgttcctccttcgtgacagccagagtaatccaaaggcgttcgtactgacactgtgccatcaccagaagattaaaaacttccagatcttaccttgcgaggatgatgggcagaccttcttcactctggatgatgggaacaccaagttctccgatctgatccagctggtcgacttctaccagctcaacaaaggtgttctgccctgcaagctgaaacaccactgcatccgcgtggccttatgacctccttgcccactcacagaggctggaggcagcgacactggaacggagaagagagatctgcatgagggtgagaacacacacctactcccacccaaggactcagaacaacatggctttttgatcggtaccaaccgacctacatcaattagttattggacttcacaaagatttgccgctgtggatcaaacaggaccacctccctctgcgtcagccatttaaaattgggggagggaagagatccagtgcaagtgtgggaagaaactggaatgacgattttgattaggccacgtagggtgaaaaccgcagaaaaatgattggaaatgaactcttgccctggaataaccttgacaattcaaaccgcgatgtttactttttgtattgatcacttttttgcactccttcttcgttgtcgatgttgtactcagcctatggtaggagaggatgtggctttgcaactcagatcagacaaagaatttttgaattggcaggctttagcctacaaatgggtcccccaagttttctagataacatcctgctctctgcaggttgcggcagtgtgggtttggctccagtccttcccattatacttgaaaagctttttttttttttttaaataaaataataagataaaaggtgacaaccgcagttgacacctagcatgttttgtggacgcagtcaagctgccacagtctggtcatcgttgttgttgtgctgacgtctggtcatgtattattagtgtgtctcgttctccacggtgctggagacctcattactttggaaaactcactgttccccagcacagcacagctgcatgacctcagcttcagactgatgtcagccagccttcttggaacacattgctattcattgtggatgccacacagtccatctggggtgccctgtgcctcccattttcacagccgcccactgttgtagaataatcgctgcctttaccctctgcagtaccctcagtcatttcacttctcccacaggggtggggtaggggtggggttaaaggatcgaaagagaaaaaaacgccaacttgttggccttgtgctctgtcactctgagcatctatggtgataaagagaaggaaacgctgcagaggcacaagcataagctggctttgagtctttgaaagcttgatggcctctgcaccctactgaaaaccccctaagccagcaggagcagggtatgcagaggctttgcctctgctggcttagggtgagaagtacctcacaatggatgtgaacattggacagattttaggagcatgatgtttgcctcctccgagagagaggagtcagagagagagaggagtcagaaggtggccggagttatcattgggtcccctgagctccatgaaggaccctctgttgtccccttgatgatttatcaggcatgagagtagcagacaggattgccttgagaaacacacagacaacaacggtggtgaacacatttccctttcttgataccacccagaaagtctgctacatacctgagttagccactagattgcctgtcccgactcattgaagtgctccccagggagccacttctgatttgccatggttgacagcatagtggaagatagatatgacagcgctttgtaaagcaggccagtggcaagctggcccacagtagagaaacactgtagttcacagaccatgcaaccgtgtttccacgagatgttattacaacaaatgaagaatttttttccttttttttcattttaatcttttttgacttttttttagttaaccattttttatgcataagtgctcaaatgcatttctctttctttcgaaactagttaatcgttaagttgacaatgagagaattctcaagttcatacctggcagcaggctcccactgatcttccccttacagacagataacagacatttcagttttaccgtgctcatttctttttgctgacttaaggtcagaacttttacagacaacaaacaaccctagggtttctttttccagtttacacagaccggtccccacagtgcagaatccatttctctttcgtctcaacagtagacaactaggatgtggatctcatatttataagtatgcattttatttaagaggaagtataggcttgactctggttcacaatttcgtacgtagctggtttgacgtagaactttgtacttcccttgccgaagtgaattgttgaaggctgcaacccacccaccttgagtgtagcagacttcagtggccccgagatcgccagccctttgcacaggcagctgggaattccacctgaaacagctggtccctaggttagcgggttcccagcccccctaatcagagactgaaggacaattgacttttatttttgtatttaattgacatgaatgtaaaggggacagctcagggttgttttggagcctgtttgactttgtaatctctgcctgtgattttcttttctaaatgacgactccgtgtaaccacctggactaagttgagaaggaaactgccaaatgctttgggtttttagggttttaataggtagactctgttctattattaggtgttaagagtttccaaacgtgttttcttttttcttttattgtttgcttaaactttgaagaaatatgtgcctcagcttagatgttttgtcttcccctttctgcacttaaatacctgacagcctgttcgatcgctgtgcctccgagggcgcttctagctcatcgtagatttgtgatgtcatagtgcaaactgcagtgaccggtaaaatgacctgacatgtaaccgttttcagggaatgcagagggtgttaactaatagacaaaacctttatcccgcgtgctttgcttcaccttgtgctatatagctctttggctcgtgaacctaattgtaaactttcaggtatttttgtacaaataagggactgatgttctgtttcttgttattagaaataaacattaataaagcgttcttggtgtc

SEQ ID NO: 20 - DNA, 4764 bp, Mus musculus
gacaccaagaacgctttattaatgtttatttctaataacaagaaacagaacatcagtcccttatttgtacaaaaatacctgaaagtttacaattaggttcacgagccaaagagctatatagcacaaggtgaagcaaagcacgcgggataaaggttttgtctattagttaacaccctctgcattccctgaaaacggttacatgtcaggtcattttaccggtcactgcagtttgcactatgacatcacaaatctacgatgagctagaagcgccctcggaggcacagcgatcgaacaggctgtcaggtatttaagtgcagaaaggggaagacaaaacatctaagctgaggcacatatttcttcaaagtttaagcaaacaataaaagaaaaaagaaaacacgtttggaaactcttaacacctaataatagaacagagtctacctattaaaaccctaaaaacccaaagcatttggcagtttccttctcaacttagtccaggtggttacacggagtcgtcatttagaaaagaaaatcacaggcagagattacaaagtcaaacaggctccaaaacaaccctgagctgtcccctttacattcatgtcaattaaatacaaaaataaaagtcaattgtccttcagtctctgattaggggggctgggaacccgctaacctagggaccagctgtttcaggtggaattcccagctgcctgtgcaaagggctggcgatctcggggccactgaagtctgctacactcaaggtgggtgggttgcagccttcaacaattcacttcggcaagggaagtacaaagttctacgtcaaaccagctacgtacgaaattgtgaaccagagtcaagcctatacttcctcttaaataaaatgcatacttataaatatgagatccacatcctagttgtctactgttgagacgaaagagaaatggattctgcactgtggggaccggtctgtgtaaactggaaaaagaaaccctagggttgtttgttgtctgtaaaagttctgaccttaagtcagcaaaaagaaatgagcacggtaaaactgaaatgtctgttatctgtctgtaaggggaagatcagtgggagcctgctgccaggtatgaacttgagaattctctcattgtcaacttaacgattaactagtttcgaaagaaagagaaatgcatttgagcacttatgcataaaaaatggttaactaaaaaaaagtcaaaaaagattaaaatgaaaaaaaaggaaaaaaattcttcatttgttgtaataacatctcgtggaaacacggttgcatggtctgtgaactacagtgtttctctactgtgggccagcttgccactggcctgctttacaaagcgctgtcatatctatcttccactatgctgtcaaccatggcaaatcagaagtggctccctggggagcacttcaatgagtcgggacaggcaatctagtggctaactcaggtatgtagcagactttctgggtggtatcaagaaagggaaatgtgttcaccaccgttgttgtctgtgtgtttctcaaggcaatcctgtctgctactctcatgcctgataaatcatcaaggggacaacagagggtccttcatggagctcaggggacccaatgataactccggccaccttctgactcctctctctctctgactcctctctctcggaggaggcaaacatcatgctcctaaaatctgtccaatgttcacatccattgtgaggtacttctcaccctaagccagcagaggcaaagcctctgcataccctgctcctgctggcttagggggttttcagtagggtgcagaggccatcaagctttcaaagactcaaagccagcttatgcttgtgcctctgcagcgtttccttctctttatcaccatagatgctcagagtgacagagcacaaggccaacaagttggcgtttttttctctttcgatcctttaaccccacccctaccccacccctgtgggagaagtgaaatgactgagggtactgcagagggtaaaggcagcgattattctacaacagtgggcggctgtgaaaatgggaggcacagggcaccccagatggactgtgtggcatccacaatgaatagcaatgtgttccaagaaggctggctgacatcagtctgaagctgaggtcatgcagctgtgctgtgctggggaacagtgagttttccaaagtaatgaggtctccagcaccgtggagaacgagacacactaataatacatgaccagacgtcagcacaacaacaacgatgaccagactgtggcagcttgactgcgtccacaaaacatgctaggtgtcaactgcggttgtcaccttttatcttattattttatttaaaaaaaaaaaaaaagcttttcaagtataatgggaaggactggagccaaacccacactgccgcaacctgcagagagcaggatgttatctagaaaacttgggggacccatttgtaggctaaagcctgccaattcaaaaattctttgtctgatctgagttgcaaagccacatcctctcctaccataggctgagtacaacatcgacaacgaagaaggagtgcaaaaaagtgatcaatacaaaaagtaaacatcgcggtttgaattgtcaaggttattccagggcaagagttcatttccaatcatttttctgcggttttcaccctacgtggcctaatcaaaatcgtcattccagtttcttcccacacttgcactggatctcttccctcccccaattttaaatggctgacgcagagggaggtggtcctgtttgatccacagcggcaaatctttgtgaagtccaataactaattgatgtaggtcggttggtaccgatcaaaaagccatgttgttctgagtccttgggtgggagtaggtgtgtgttctcaccctcatgcagatctctcttctccgttccagtgtcgctgcctccagcctctgtgagtgggcaaggaggtcataaggccacgcggatgcagtggtgtttcagcttgcagggcagaacacctttgttgagctggtagaagtcgaccagctggatcagatcggagaacttggtgttcccatcatccagagtgaagaaggtctgcccatcatcctcgcaaggtaagatctggaagtttttaatcttctggtgatggcacagtgtcagtacgaacgcctttggattactctggctgtcacgaaggaggaacagcccgtccacgagaccttgttgcttgatgatcctgtgagactcctcgcgggagatacgtccatggaaccaatgctgagtcctgtgaatcactgcattcagggtagaaggatgcagtgggctttggctgcttaggatattcatccgtgtgctccgcttacgccaggcatggccctcttccagggcagcactctgggcttcagccgggttatcgatcactcttccgatttgtccagaaaaatccatggccacaagagaattctcagaaacactgcgcataggtgcgttgaaaggagggggcagacccttcctctgtgggatgcgatagttttggtacaggagcattccgtacttgagcagtctgaaggcagtcatccagcaagtacggatctgctcatcttcggcacagagcagacgaagctccttcatctcggtcttcgctttgtttggcttgatgcacatcccatgttcattcggcgcgttgtactgcttctttccagcaatcaggtagaagatgctgctttcttccaggtcagccagcagctgcaggtgtctgggttcttttgaagtccccttggtggagtaatagaggccagatctgcgcaggcacacatacagcttcttccaagacttgcgtcctacctctttcacctgcaagaacccctggatctcagggcagctgctggtgttcagaaaattctgcagaagctgcgcctggccaccgttggactgctggcaccaattgaccatctgatccgggaagaagttcactggattcttaaagaactcgtacttcgcataattctttctgaataagaatttgctctcacttggcatggtactctccacttggaccacgatctcatggtcctccaggcacctctctaatcccagttgtgggtggtgttccaccagagtccagctgttgtcatccacacagtgacttttgtaaaccagcagctggcacaggtccctggctgtcatgtcggttagaatctccaccactttgctggtcccatcttcactaaagactttgacatcatgcttggcaggtggctggctcggaggaggaggtaaggagctaggagcaaccgaaggagggctcccaggggccgcaccagtgagctccggaaatgggttggggatggccggaagagatgcagttcttaactgctggtcttcctcctgaaggcgcctgagaatgtgcacaggctgcgagcgttgcattttctgcctcggggacgcctgtggctgtccccgggagctagatgctgctccctggttgctggcatgctggccatcctcaagaagtggtgcagtatcagtatcagactgcatgttgcaagctgagttaaggctttccacggacgagttaatatcgttgttcattagtacttgaagcccaagaccatgctctggttggcttctttgttgtggcgaaaacccagacttagctaggttttcgggtttggacgttgactgccccactttgtccaaggtacagagctaggacgcagtagatttcacactctcctctaacagacagaaactgtagatggcgat

SEQ ID NO: 21 - DNA, 5164 bp, Mus musculus
atcgagggggtggggtgcggggaggcggcaggaagggaagggcgctgcgaccagtggcgggcgggattcgcgttccgagacccacgggagcacgaagtttccgcgcaccgtctcacgcacggcgactgggaccgtccagtgtccggctttgccttcggtttttctccgttgtgactcgtgcaacgtgtggccagcggccacgcggaggcgacgaggagctgcacgtcaggacaaagtggggcagtcaacgtccaaacccgaaaacctagctaagtctgggttttcgccacaacaaagaagccaaccagagcatggtcttgggcttcaagtactaatgaacaacgatattaactcgtccgtggaaagccttaactcagcttgcaacatgcagtctgatactgatactgcaccacttcttgaggatggccagcatgccagcaaccagggagcagcatctagctcccggggacagccacaggcgtccccgaggcagaaaatgcaacgctcgcagcctgtgcacattctcaggcgccttcaggaggaagaccagcagttaagaactgcatctcttccggccatccccaacccatttccggagctcactggtgcggcccctgggagccctccttcggttgctcctagctccttacctcctcctccgagccagccacctgccaagcattgtggcagatgtgagaagtggataccaggggaaaatacccggggaaatgggaaacggaagatctggagatggcagttccctccaggctttcagctgtcgaaactcacccgtccaggtctgtggacaaagaccactgcgagattttcaaagaaacaacctaagaaccagtgtccaaccgacactgtgaatccagtggcacggatgcccacttcacagatggagaagctgaggctcagaaaggatgtcaaagtctttagtgaagatgggaccagcaaagtggtggagattctaaccgacatgacagccagggacctgtgccagctgctggtttacaaaagtcactgtgtggatgacaacagctggactctggtggaacaccacccacaactgggattagagaggtgcctggaggaccatgagatcgtggtccaagtggagagtaccatgccaagtgagagcaaattcttattcagaaagaattatgcgaagtacgagttctttaagaatccagtgaacttcttcccggatcagatggtcaattggtgccagcagtccaacggtggccaggcgcagcttctgcagaattttctgaacaccagcagctgccctgagatccaggggttcttgcaggtgaaagaggtaggacgcaagtcttggaagaagctgtatgtgtgcctgcgcagatctggcctctattactccaccaaggggacttcaaaagaacccagacacctgcagctgctggctgacctggaagaaagcagcatcttctacctgattgctggaaagaagcagtacaacgcgccgaatgaacatgggatgtgcatcaagccaaacaaagcgaagaccgagatgaaggagcttcgtctgctctgtgccgaagatgagcagatccgtacttgctggatgactgccttcagactgctcaagtacggaatgctcctgtaccaaaactatcgcatcccacagaggaagggtctgccccctcctttcaacgcacctatgcgcagtgtttctgagaattctcttgtggccatggatttttctggacaaatcggaagagtgatcgataacccggctgaagcccagagtgctgccctggaagagggccatgcctggcgtaagcggagcacacggatgaatatcctaagcagccaaagcccactgcatccttctaccctgaatgcagtgattcacaggactcagcattggttccatggacgtatctcccgcgaggagtctcacaggatcatcaagcaacaaggtctcgtggacgggctgttcctccttcgtgacagccagagtaatccaaaggcgttcgtactgacactgtgccatcaccagaagattaaaaacttccagatcttaccttgcgaggatgatgggcagaccttcttcactctggatgatgggaacaccaagttctccgatctgatccagctggtcgacttctaccagctcaacaaaggtgttctgccctgcaagctgaaacaccactgcatccgcgtggccttatgacctccttgcccactcacagaggctggaggcagcgacactggaacggagaagagagatctgcatgagggtgagaacacacacctactcccacccaaggactcagaacaacatggctttttgatcggtaccaaccgacctacatcaattagttattggacttcacaaagatttgccgctgtggatcaaacaggaccacctccctctgcgtcagccatttaaaattgggggagggaagagatccagtgcaagtgtgggaagaaactggaatgacgattttgattaggccacgtagggtgaaaaccgcagaaaaatgattggaaatgaactcttgccctggaataaccttgacaattcaaaccgcgatgtttactttttgtattgatcacttttttgcactccttcttcgttgtcgatgttgtactcagcctatggtaggagaggatgtggctttgcaactcagatcagacaaagaatttttgaattggcaggctttagcctacaaatgggtcccccaagttttctagataacatcctgctctctgcaggttgcggcagtgtgggtttggctccagtccttcccattatacttgaaaagctttttttttttttttaaataaaataataagataaaaggtgacaaccgcagttgacacctagcatgttttgtggacgcagtcaagctgccacagtctggtcatcgttgttgttgtgctgacgtctggtcatgtattattagtgtgtctcgttctccacggtgctggagacctcattactttggaaaactcactgttccccagcacagcacagctgcatgacctcagcttcagactgatgtcagccagccttcttggaacacattgctattcattgtggatgccacacagtccatctggggtgccctgtgcctcccattttcacagccgcccactgttgtagaataatcgctgcctttaccctctgcagtaccctcagtcatttcacttctcccacaggggtggggtaggggtggggttaaaggatcgaaagagaaaaaaacgccaacttgttggccttgtgctctgtcactctgagcatctatggtgataaagagaaggaaacgctgcagaggcacaagcataagctggctttgagtctttgaaagcttgatggcctctgcaccctactgaaaaccccctaagccagcaggagcagggtatgcagaggctttgcctctgctggcttagggtgagaagtacctcacaatggatgtgaacattggacagattttaggagcatgatgtttgcctcctccgagagagaggagtcagagagagagaggagtcagaaggtggccggagttatcattgggtcccctgagctccatgaaggaccctctgttgtccccttgatgatttatcaggcatgagagtagcagacaggattgccttgagaaacacacagacaacaacggtggtgaacacatttccctttcttgataccacccagaaagtctgctacatacctgagttagccactagattgcctgtcccgactcattgaagtgctccccagggagccacttctgatttgccatggttgacagcatagtggaagatagatatgacagcgctttgtaaagcaggccagtggcaagctggcccacagtagagaaacactgtagttcacagaccatgcaaccgtgtttccacgagatgttattacaacaaatgaagaatttttttccttttttttcattttaatcttttttgacttttttttagttaaccattttttatgcataagtgctcaaatgcatttctctttctttcgaaactagttaatcgttaagttgacaatgagagaattctcaagttcatacctggcagcaggctcccactgatcttccccttacagacagataacagacatttcagttttaccgtgctcatttctttttgctgacttaaggtcagaacttttacagacaacaaacaaccctagggtttctttttccagtttacacagaccggtccccacagtgcagaatccatttctctttcgtctcaacagtagacaactaggatgtggatctcatatttataagtatgcattttatttaagaggaagtataggcttgactctggttcacaatttcgtacgtagctggtttgacgtagaactttgtacttcccttgccgaagtgaattgttgaaggctgcaacccacccaccttgagtgtagcagacttcagtggccccgagatcgccagccctttgcacaggcagctgggaattccacctgaaacagctggtccctaggttagcgggttcccagcccccctaatcagagactgaaggacaattgacttttatttttgtatttaattgacatgaatgtaaaggggacagctcagggttgttttggagcctgtttgactttgtaatctctgcctgtgattttcttttctaaatgacgactccgtgtaaccacctggactaagttgagaaggaaactgccaaatgctttgggtttttagggttttaataggtagactctgttctattattaggtgttaagagtttccaaacgtgttttcttttttcttttattgtttgcttaaactttgaagaaatatgtgcctcagcttagatgttttgtcttcccctttctgcacttaaatacctgacagcctgttcgatcgctgtgcctccgagggcgcttctagctcatcgtagatttgtgatgtcatagtgcaaactgcagtgaccggtaaaatgacctgacatgtaaccgttttcagggaatgcagagggtgttaactaatagacaaaacctttatcccgcgtgctttgcttcaccttgtgctatatagctctttggctcgtgaacctaattgtaaactttcaggtatttttgtacaaataagggactgatgttctgtttcttgttattagaaataaacattaataaagcgttcttggtgtc

SEQ ID NO: 22 - DNA, 5164 bp, Mus musculus
gacaccaagaacgctttattaatgtttatttctaataacaagaaacagaacatcagtcccttatttgtacaaaaatacctgaaagtttacaattaggttcacgagccaaagagctatatagcacaaggtgaagcaaagcacgcgggataaaggttttgtctattagttaacaccctctgcattccctgaaaacggttacatgtcaggtcattttaccggtcactgcagtttgcactatgacatcacaaatctacgatgagctagaagcgccctcggaggcacagcgatcgaacaggctgtcaggtatttaagtgcagaaaggggaagacaaaacatctaagctgaggcacatatttcttcaaagtttaagcaaacaataaaagaaaaaagaaaacacgtttggaaactcttaacacctaataatagaacagagtctacctattaaaaccctaaaaacccaaagcatttggcagtttccttctcaacttagtccaggtggttacacggagtcgtcatttagaaaagaaaatcacaggcagagattacaaagtcaaacaggctccaaaacaaccctgagctgtcccctttacattcatgtcaattaaatacaaaaataaaagtcaattgtccttcagtctctgattaggggggctgggaacccgctaacctagggaccagctgtttcaggtggaattcccagctgcctgtgcaaagggctggcgatctcggggccactgaagtctgctacactcaaggtgggtgggttgcagccttcaacaattcacttcggcaagggaagtacaaagttctacgtcaaaccagctacgtacgaaattgtgaaccagagtcaagcctatacttcctcttaaataaaatgcatacttataaatatgagatccacatcctagttgtctactgttgagacgaaagagaaatggattctgcactgtggggaccggtctgtgtaaactggaaaaagaaaccctagggttgtttgttgtctgtaaaagttctgaccttaagtcagcaaaaagaaatgagcacggtaaaactgaaatgtctgttatctgtctgtaaggggaagatcagtgggagcctgctgccaggtatgaacttgagaattctctcattgtcaacttaacgattaactagtttcgaaagaaagagaaatgcatttgagcacttatgcataaaaaatggttaactaaaaaaaagtcaaaaaagattaaaatgaaaaaaaaggaaaaaaattcttcatttgttgtaataacatctcgtggaaacacggttgcatggtctgtgaactacagtgtttctctactgtgggccagcttgccactggcctgctttacaaagcgctgtcatatctatcttccactatgctgtcaaccatggcaaatcagaagtggctccctggggagcacttcaatgagtcgggacaggcaatctagtggctaactcaggtatgtagcagactttctgggtggtatcaagaaagggaaatgtgttcaccaccgttgttgtctgtgtgtttctcaaggcaatcctgtctgctactctcatgcctgataaatcatcaaggggacaacagagggtccttcatggagctcaggggacccaatgataactccggccaccttctgactcctctctctctctgactcctctctctcggaggaggcaaacatcatgctcctaaaatctgtccaatgttcacatccattgtgaggtacttctcaccctaagccagcagaggcaaagcctctgcataccctgctcctgctggcttagggggttttcagtagggtgcagaggccatcaagctttcaaagactcaaagccagcttatgcttgtgcctctgcagcgtttccttctctttatcaccatagatgctcagagtgacagagcacaaggccaacaagttggcgtttttttctctttcgatcctttaaccccacccctaccccacccctgtgggagaagtgaaatgactgagggtactgcagagggtaaaggcagcgattattctacaacagtgggcggctgtgaaaatgggaggcacagggcaccccagatggactgtgtggcatccacaatgaatagcaatgtgttccaagaaggctggctgacatcagtctgaagctgaggtcatgcagctgtgctgtgctggggaacagtgagttttccaaagtaatgaggtctccagcaccgtggagaacgagacacactaataatacatgaccagacgtcagcacaacaacaacgatgaccagactgtggcagcttgactgcgtccacaaaacatgctaggtgtcaactgcggttgtcaccttttatcttattattttatttaaaaaaaaaaaaaaagcttttcaagtataatgggaaggactggagccaaacccacactgccgcaacctgcagagagcaggatgttatctagaaaacttgggggacccatttgtaggctaaagcctgccaattcaaaaattctttgtctgatctgagttgcaaagccacatcctctcctaccataggctgagtacaacatcgacaacgaagaaggagtgcaaaaaagtgatcaatacaaaaagtaaacatcgcggtttgaattgtcaaggttattccagggcaagagttcatttccaatcatttttctgcggttttcaccctacgtggcctaatcaaaatcgtcattccagtttcttcccacacttgcactggatctcttccctcccccaattttaaatggctgacgcagagggaggtggtcctgtttgatccacagcggcaaatctttgtgaagtccaataactaattgatgtaggtcggttggtaccgatcaaaaagccatgttgttctgagtccttgggtgggagtaggtgtgtgttctcaccctcatgcagatctctcttctccgttccagtgtcgctgcctccagcctctgtgagtgggcaaggaggtcataaggccacgcggatgcagtggtgtttcagcttgcagggcagaacacctttgttgagctggtagaagtcgaccagctggatcagatcggagaacttggtgttcccatcatccagagtgaagaaggtctgcccatcatcctcgcaaggtaagatctggaagtttttaatcttctggtgatggcacagtgtcagtacgaacgcctttggattactctggctgtcacgaaggaggaacagcccgtccacgagaccttgttgcttgatgatcctgtgagactcctcgcgggagatacgtccatggaaccaatgctgagtcctgtgaatcactgcattcagggtagaaggatgcagtgggctttggctgcttaggatattcatccgtgtgctccgcttacgccaggcatggccctcttccagggcagcactctgggcttcagccgggttatcgatcactcttccgatttgtccagaaaaatccatggccacaagagaattctcagaaacactgcgcataggtgcgttgaaaggagggggcagacccttcctctgtgggatgcgatagttttggtacaggagcattccgtacttgagcagtctgaaggcagtcatccagcaagtacggatctgctcatcttcggcacagagcagacgaagctccttcatctcggtcttcgctttgtttggcttgatgcacatcccatgttcattcggcgcgttgtactgcttctttccagcaatcaggtagaagatgctgctttcttccaggtcagccagcagctgcaggtgtctgggttcttttgaagtccccttggtggagtaatagaggccagatctgcgcaggcacacatacagcttcttccaagacttgcgtcctacctctttcacctgcaagaacccctggatctcagggcagctgctggtgttcagaaaattctgcagaagctgcgcctggccaccgttggactgctggcaccaattgaccatctgatccgggaagaagttcactggattcttaaagaactcgtacttcgcataattctttctgaataagaatttgctctcacttggcatggtactctccacttggaccacgatctcatggtcctccaggcacctctctaatcccagttgtgggtggtgttccaccagagtccagctgttgtcatccacacagtgacttttgtaaaccagcagctggcacaggtccctggctgtcatgtcggttagaatctccaccactttgctggtcccatcttcactaaagactttgacatcctttctgagcctcagcttctccatctgtgaagtgggcatccgtgccactggattcacagtgtcggttggacactggttcttaggttgtttctttgaaaatctcgcagtggtctttgtccacagacctggacgggtgagtttcgacagctgaaagcctggagggaactgccatctccagatcttccgtttcccatttccccgggtattttcccctggtatccacttctcacatctgccacaatgcttggcaggtggctggctcggaggaggaggtaaggagctaggagcaaccgaaggagggctcccaggggccgcaccagtgagctccggaaatgggttggggatggccggaagagatgcagttcttaactgctggtcttcctcctgaaggcgcctgagaatgtgcacaggctgcgagcgttgcattttctgcctcggggacgcctgtggctgtccccgggagctagatgctgctccctggttgctggcatgctggccatcctcaagaagtggtgcagtatcagtatcagactgcatgttgcaagctgagttaaggctttccacggacgagttaatatcgttgttcattagtacttgaagcccaagaccatgctctggttggcttctttgttgtggcgaaaacccagacttagctaggttttcgggtttggacgttgactgccccactttgtcctgacgtgcagctcctcgtcgcctccgcgtggccgctggccacacgttgcacgagtcacaacggagaaaaaccgaaggcaaagccggacactggacggtcccagtcgccgtgcgtgagacggtgcgcggaaacttcgtgctcccgtgggtctcggaacgcgaatcccgcccgccactggtcgcagcgcccttcccttcctgccgcctccccgcaccccaccccctcgat

SEQ ID NO: 23 - DNA, 4996 bp, Rattus norvegicus
tgaggagagcggtagaggaccagggaccagctcagcaggacaggcttcccagcacctgtgctataatgggggacaaagtggggcagtcaacgtccaaatccgaaaacctagctaagtctgggttttcgccacaaccaagaagccaaccagagcatgctcttgggcttcaagtcctaatgaacaacgatattaactcatccgtggaaagccttaactcagcttgcaacatgcagtctgacactgacactgtgccacttcttgagaatggccagagtgccagcaaccagccgtcagcatccagctcccggggacagcctcaggcgtccccgaggcagaagatgcagcgctcgcagcctgtgcacattcaaccgctcaggcgccttcaggaggaagaccagcagctccgaacttcatctcttccggccatccccaatccgtttccggagctcgctgggggggcccctgggagccctccttcggttgctcctagctccttacctcctcctccgagccagcctcctgccaagcatatgtgacaagtggacaccagggggaaatacccagggcattggggaaactgaagatctggagatgacagatggttccctccaggctttcagctggcgaaactcacccgtccaggtctgtggacaaagaccactgcgagattttcaaagaggcaacctaagaaccagtgtcaaaccgacactgcgaatgcagtgtcacggattcccacttcacagatggagaagctgaggctcagaaaggatgtcaaagtctttagtgaagatgggacaagcaaagtggtggagattctaaccgacatgactgccagggacctgtgccagctgctggtttacaaaagtcactgtgtggatgacaacagctggactctggtggagcaccacccacaactgggactagagaggtgcctggaggaccatgagatcgtggtccaagtggagagcaccatgccaagtgagagtaaattcttattcagaaagaactatgccaagtacgagttctttaagaaccctgtgaacttctttccggatcagatggtcacctggtgccagcagtccaacggtggccaggcccagcttctgcagaatttcctgaactccagcagctgccctgagatccaggggttcttgcaggtgaaggaggtgggacgcaagtcttggaagaagctgtatgtgtgcctgcgcagatctggcctttattactccaccaaggggacttcaaaggaacccagacacctgcagctgctggctgacctcgaagaaagcagcatcttctacctgattgccggaaagaagcagtacaacgcacccaatgaacacgggatgtgcatcaagccaaacaaagcgaagatcgagatgaaggagctgcgtctgctctgtgccgaagatgagcagatccgtacttgctggatgacagccttcagactgctcaagtatggaatgctcctgtaccaaaactatcgcatcccgcagcagagaaagggtttggctcctcctttcaacgcgcctatgcgcagtgtttctgagaattctcttgtggccatggatttttctggacaaattggaagagtgattgataacccggctgaagcccagagtgctgccctggaagagggccatgcctggcggaagcgaagcacaaggatgaatatcctaagcagccaaagtccccttcatccttcgaccctgaattcggtgattcacaggactcagcattggttccatggacgtatctctcgcgaggaatctcacaggatcatcaagcaacaaggtctcgtggacgggctgttcctcctccgtgacagtcagagcaatccaaaggctttcgtgctgacgctgtgtcaccagcagaagattagaaacttccagatcttaccctgcgaggatgatgggcaaaccttcttcactctggatgatgggaacaccaagttctcggatctgattcagctggtcgacttctaccagctcaacaaaggcgtcctgccctgcaagctgaagcaccactgcatccgcgtggccttatgacctccttgcccactcaggctggaggcagcaacactggaacggagaagagaggcctgcatgagggtgagaacacacacccactcccacccaaggactcagaataacatggctttctgatcggtaccaaccgaccaacatcaattagttattggactttacaaagatttgccgctgcggatcaaacaggaccacctccctctgcatcagccatttaaattgggggagggaagagatccagtgcaagtgtgggaagaaactggaatgatgattttgattaggccacgtagggtgaaaaccgcagagaaaagattggaaatgaactcttgccctggaataaccttgacaattcaaaccgcgatgtttactttttgtattgatcacttttttgcactccttcttcgttgtcaatgttgtactcagcctatggtaggagaggatgtggctttgcaacccagatgagacaaagattttttgaattggcaggcttcggcctacaaatgggtcccccaagttttcttagatggcatcctgcgctctgcaggttatgacagtgtggatttggctcctacattatagacaccccagtccttcccattatacttgaaaagctttttttttttttttaagaaataataaaataaaaagtgtcaaccgcagttgacaccaagcatgttttgtggacgcagtcaagctgccacagtctggtcatcgttgttgttgtgctgacgtctggtcatttattattagtgtgtctcgttctccagtgccggagacctcattactttggaaaactcgctgttccccagcgcagcacagccgcatgagctcagcttcagactgatgtccgccagccttcttggaacacattggtattcattgtggatgccacacaatccatccggggtgcctcgtgcctcccattttcacagccgcccactgttgtagaatgatcgctgcctttaccctctgcagtagcctccgccatttcagttctcccacaggggtggggtgggggtggggttaaaggatcgaaagagaaaaatgccaacttgttggccttgtgctcttgtcactctgagcatgtttggtgattaaagagaaggaaacactgcagaggcacaggcataggctggctttgagtcttcgcttgatgacctctgcaccctactgaaaaccccctaagccagccggagcagggtatgaagaggtcctgcctctgctggcttagggtgagaagtacctcacagtggttgtgaacattggatagtttttaggaggatgatgtttgcctcctttgagaaaggagtcagaaggtggccggagtgatcattggtcccctgagctccatggaggaccctctgttgtccccttgatgattcatcaggcatgagagtagcagacaggactcccttgaggaacacagacagctgtggtgatcacatttatttccctttcttgacaccacacaggaagtctgctacacacctgagctagccactagattgcctgtcccgactgcgcgaagtgctccccagggagccacttctgattgcgctgcggttgacggcccggtggaagattaatgacagcgctttgtaacgcaggccagcggcacgctggtccacggtgtaggaacactgtagttcacagaccacgcaaccgtgtttccacgagatgttattacaacaaatgaagaatttttttcctttttttcattttaatcttttttgacttttttttagtaaaacattttcttacgcataaacgctcaattgcatttctctttctttcgcagctagttaatcattcagttgacaatgagagaattctcaagttcatacttggcagcaggctcccactgatcttccccttgagacaaatagtggacatttcagttttaccatattcatttctttccgctgacttcgaggtcagacctttacaaacagataacaaacagccctaggatttctttctccagtttacacagaccagtccccacagtgcataaccctttactcttctgcctctacagtagacagctaagatgtgtatctcatatttataagtacgcattctatttaagcggaagtataggcttgactctggttcacaattttgtacgtagctggtttgacgtagtattttgtacttcccttgctgaagtgaattgttgaaggctgcaagccacccgccttgagtgcagcagacttcagtgaccccgagctcgctcaccagcctttgcacaggtagctgggaattccaccagaaacagctggtccctaggttagcgggcacccagccgcccctaaccggagactgaaggacaattgacttttatttttgtatttaattgacatgaatgtaaggggacagctcagggttgtttggagcctgtttgactttgcaatctctgcctgtgattttcttttcttaagaacaactccgtgtaaccacctggactaagttgagaaggaaaatgccaaatgctttgggtttttagcgttttaatacgtaggctctgttatattattaggtgttaagagtttccaaacgtgttttcttttttctttttttgtttgcttaaactttgaagaaatatgtgcctcagcttagatgttttgtcttctcctttctgcacttaaatacctgacagcctgtccgatcactgtgcctccgagggcgctactagctcatcgtagatttgtgatatcatagtgtaaactgcagtgaccggaaaatgacctgacatgtaaacgttttcagggaatgcagagggtgttaattgatagacaaaacctttatcccgcgtgctttgcttcactctgtgctatatagctctttggctcgtgaacctaattgtaaactttcaggtatttttgtacaaataagggactgatgttctgtttcttgttattagaaataaacattaataaagtgttcttcat

SEQ ID NO: 24 - DNA, 4996 bp, Rattus norvegicus
atgaagaacactttattaatgtttatttctaataacaagaaacagaacatcagtcccttatttgtacaaaaatacctgaaagtttacaattaggttcacgagccaaagagctatatagcacagagtgaagcaaagcacgcgggataaaggttttgtctatcaattaacaccctctgcattccctgaaaacgtttacatgtcaggtcattttccggtcactgcagtttacactatgatatcacaaatctacgatgagctagtagcgccctcggaggcacagtgatcggacaggctgtcaggtatttaagtgcagaaaggagaagacaaaacatctaagctgaggcacatatttcttcaaagtttaagcaaacaaaaaaagaaaaaagaaaacacgtttggaaactcttaacacctaataatataacagagcctacgtattaaaacgctaaaaacccaaagcatttggcattttccttctcaacttagtccaggtggttacacggagttgttcttaagaaaagaaaatcacaggcagagattgcaaagtcaaacaggctccaaacaaccctgagctgtccccttacattcatgtcaattaaatacaaaaataaaagtcaattgtccttcagtctccggttaggggcggctgggtgcccgctaacctagggaccagctgtttctggtggaattcccagctacctgtgcaaaggctggtgagcgagctcggggtcactgaagtctgctgcactcaaggcgggtggcttgcagccttcaacaattcacttcagcaagggaagtacaaaatactacgtcaaaccagctacgtacaaaattgtgaaccagagtcaagcctatacttccgcttaaatagaatgcgtacttataaatatgagatacacatcttagctgtctactgtagaggcagaagagtaaagggttatgcactgtggggactggtctgtgtaaactggagaaagaaatcctagggctgtttgttatctgtttgtaaaggtctgacctcgaagtcagcggaaagaaatgaatatggtaaaactgaaatgtccactatttgtctcaaggggaagatcagtgggagcctgctgccaagtatgaacttgagaattctctcattgtcaactgaatgattaactagctgcgaaagaaagagaaatgcaattgagcgtttatgcgtaagaaaatgttttactaaaaaaaagtcaaaaaagattaaaatgaaaaaaaggaaaaaaattcttcatttgttgtaataacatctcgtggaaacacggttgcgtggtctgtgaactacagtgttcctacaccgtggaccagcgtgccgctggcctgcgttacaaagcgctgtcattaatcttccaccgggccgtcaaccgcagcgcaatcagaagtggctccctggggagcacttcgcgcagtcgggacaggcaatctagtggctagctcaggtgtgtagcagacttcctgtgtggtgtcaagaaagggaaataaatgtgatcaccacagctgtctgtgttcctcaagggagtcctgtctgctactctcatgcctgatgaatcatcaaggggacaacagagggtcctccatggagctcaggggaccaatgatcactccggccaccttctgactcctttctcaaaggaggcaaacatcatcctcctaaaaactatccaatgttcacaaccactgtgaggtacttctcaccctaagccagcagaggcaggacctcttcataccctgctccggctggcttagggggttttcagtagggtgcagaggtcatcaagcgaagactcaaagccagcctatgcctgtgcctctgcagtgtttccttctctttaatcaccaaacatgctcagagtgacaagagcacaaggccaacaagttggcatttttctctttcgatcctttaaccccacccccaccccacccctgtgggagaactgaaatggcggaggctactgcagagggtaaaggcagcgatcattctacaacagtgggcggctgtgaaaatgggaggcacgaggcaccccggatggattgtgtggcatccacaatgaataccaatgtgttccaagaaggctggcggacatcagtctgaagctgagctcatgcggctgtgctgcgctggggaacagcgagttttccaaagtaatgaggtctccggcactggagaacgagacacactaataataaatgaccagacgtcagcacaacaacaacgatgaccagactgtggcagcttgactgcgtccacaaaacatgcttggtgtcaactgcggttgacactttttattttattatttcttaaaaaaaaaaaaaaagcttttcaagtataatgggaaggactggggtgtctataatgtaggagccaaatccacactgtcataacctgcagagcgcaggatgccatctaagaaaacttgggggacccatttgtaggccgaagcctgccaattcaaaaaatctttgtctcatctgggttgcaaagccacatcctctcctaccataggctgagtacaacattgacaacgaagaaggagtgcaaaaaagtgatcaatacaaaaagtaaacatcgcggtttgaattgtcaaggttattccagggcaagagttcatttccaatcttttctctgcggttttcaccctacgtggcctaatcaaaatcatcattccagtttcttcccacacttgcactggatctcttccctcccccaatttaaatggctgatgcagagggaggtggtcctgtttgatccgcagcggcaaatctttgtaaagtccaataactaattgatgttggtcggttggtaccgatcagaaagccatgttattctgagtccttgggtgggagtgggtgtgtgttctcaccctcatgcaggcctctcttctccgttccagtgttgctgcctccagcctgagtgggcaaggaggtcataaggccacgcggatgcagtggtgcttcagcttgcagggcaggacgcctttgttgagctggtagaagtcgaccagctgaatcagatccgagaacttggtgttcccatcatccagagtgaagaaggtttgcccatcatcctcgcagggtaagatctggaagtttctaatcttctgctggtgacacagcgtcagcacgaaagcctttggattgctctgactgtcacggaggaggaacagcccgtccacgagaccttgttgcttgatgatcctgtgagattcctcgcgagagatacgtccatggaaccaatgctgagtcctgtgaatcaccgaattcagggtcgaaggatgaaggggactttggctgcttaggatattcatccttgtgcttcgcttccgccaggcatggccctcttccagggcagcactctgggcttcagccgggttatcaatcactcttccaatttgtccagaaaaatccatggccacaagagaattctcagaaacactgcgcataggcgcgttgaaaggaggagccaaaccctttctctgctgcgggatgcgatagttttggtacaggagcattccatacttgagcagtctgaaggctgtcatccagcaagtacggatctgctcatcttcggcacagagcagacgcagctccttcatctcgatcttcgctttgtttggcttgatgcacatcccgtgttcattgggtgcgttgtactgcttctttccggcaatcaggtagaagatgctgctttcttcgaggtcagccagcagctgcaggtgtctgggttcctttgaagtccccttggtggagtaataaaggccagatctgcgcaggcacacatacagcttcttccaagacttgcgtcccacctccttcacctgcaagaacccctggatctcagggcagctgctggagttcaggaaattctgcagaagctgggcctggccaccgttggactgctggcaccaggtgaccatctgatccggaaagaagttcacagggttcttaaagaactcgtacttggcatagttctttctgaataagaatttactctcacttggcatggtgctctccacttggaccacgatctcatggtcctccaggcacctctctagtcccagttgtgggtggtgctccaccagagtccagctgttgtcatccacacagtgacttttgtaaaccagcagctggcacaggtccctggcagtcatgtcggttagaatctccaccactttgcttgtcccatcttcactaaagactttgacatcctttctgagcctcagcttctccatctgtgaagtgggaatccgtgacactgcattcgcagtgtcggtttgacactggttcttaggttgcctctttgaaaatctcgcagtggtctttgtccacagacctggacgggtgagtttcgccagctgaaagcctggagggaaccatctgtcatctccagatcttcagtttccccaatgccctgggtatttccccctggtgtccacttgtcacatatgcttggcaggaggctggctcggaggaggaggtaaggagctaggagcaaccgaaggagggctcccaggggcccccccagcgagctccggaaacggattggggatggccggaagagatgaagttcggagctgctggtcttcctcctgaaggcgcctgagcggttgaatgtgcacaggctgcgagcgctgcatcttctgcctcggggacgcctgaggctgtccccgggagctggatgctgacggctggttgctggcactctggccattctcaagaagtggcacagtgtcagtgtcagactgcatgttgcaagctgagttaaggctttccacggatgagttaatatcgttgttcattaggacttgaagcccaagagcatgctctggttggcttcttggttgtggcgaaaacccagacttagctaggttttcggatttggacgttgactgccccactttgtcccccattatagcacaggtgctgggaagcctgtcctgctgagctggtccctggtcctctaccgctctcctca

SEQ ID NO: 25 - DNA, 4702 bp, Macaca mulatta
atttgaagaaggcagaaggaacccatggctttagctggctgcccagattcctttttgcaccatccgtactaccaggacaaggtggagcagacacctcgcagtcaacaagacccggcaggaccaggactccccgcacagtctgaccgactcacacatcaccaggaggatgatgtggacctggaagccctggtgaacgatatgaacgcatccctggatagcctgtactcagcctgcagcatgcagtcagacacagtgcccctcctgcagaatggccagcatgaccgcagccaacctcgggcttcaggccctcggtccgtccagccacaggtgtccccgaggcagagggtgcagcgctcccagcctgtgcacatacttgctgtcaggcgccttcaggaggaagaccagcaatttagaacctcgtctctgccggccatcccgaatccttttcctgaactctgtggccctgggagcccccctgtgctcacgccgggttctttacctccgagccaggccgccgcaaagcaggatgttaaagtctttagtgaagatgggacgagcaaagtggtggagattctagcagacatgacagccagggacctgtgccaattgctggtttacaaaagtcactgtgtggatgacaacagctggacactagtggagcaccacccgcacctaggattagagaggtgcttggaagaccacgagctggtggtccaagtggagagtaccatggccagtgagagtaaatttctattcaggaagaattatgcaaaatacgagttctttaaaaatcccatgaatttcttcccagaacagatggttacttggtgccagcagtcaaatggcagtcaaagccagcttttgcagaattttctgaactccagtagctgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgccggcaggaagcagtacagcgcccctacagaccacgggctctgcataaagccaaacaaagtcaggaatgaagctaaagagctgaggttgctctgtgcagaggatgagcaaaccaggacgtgctggatgacagcgttcagactcctgaagtatggaatgctcctttaccagaactaccgaatccctcagcagaggaaggccttgctatccccgttctcaacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggacgggctttttctcctccgtgacagccagagtaatccaaaggcatttgtactcacactgtgtcatcaccagaaaattaaaaatttccagatcttaccttgcgaggatgatgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagattggaggaagtgaacactggactgaagaagcggtctgtgcattggttaagaacacacattgattctgcacctggggacccaaagcgagatgggttcgttcagtgccagccaaccaagattgactagtttgttggacttaaatgacgatttgctgctgtgaacccagcagggtcgcctccctctgcgtcggccaaattggggagggcttggaagatccagcggaaatttgaaaataaactggaatgatcattttggcttgggccgcttaggagcaagaaccagagagaaatgattggaaatgaactcttgccctggaataatcttgacaattaaaactgatatgtttactttttttgtattgatcacttttttgcactccttctttgttttcaatattgtattcagcctatggtaggagggggatgtggcgtttcaactcatataatacagaaagagtttcgaacgggcagacttcaaactgagtatgggtccccaaatgttcccagagggtcctccgcaccctctgccaaataccacggtgtggattcagctcccaaatgacaaacccagcccttcccagtatacttgaaaagcttttctgttaaaataaaaggtgtcactgtggtaggcatttggcatgttttgtggactcagtcaagcaaccacagtctgttaatcatttctctatgctcagatgtcagatcctcttgttattagcgtgtcttgttctgcacagtgcaggagactttattcctttggaaaattcactgttccacaaacagcaggctgaatggcctcgcctctagactgacgtgggccagcctccttgagacacacctggcacccgtcatcggccagcggtggatgctgcataatccacctgggtactttcagccttgcgtttccacggccttcagcctgttctagaacgatcactgccttacccctgctgctgcagtggtgtgagtcgtttcacggctgatgtccctcgggggattaaaggatctaaagagagaatggcacctggttggcttcgtgctgtgtctcgtgggtttccatggtgataaagacaaggaaacgctgcagaggtcacaggcacagggtgatatttaaagatctttgcttgcagccctccgtcctgctgagaacccccataagccagtgaacgcagagcccttagaggctcctctgctggcttagggtgcagagtacctcacggtggttgtggacatggaagagttttgtcaacacaacacttcctccctgctccgggagatgagtcagacggtggcttgagttgtcacttggtcccctccgcccctcgggtggccccctttgccatgtccccttagcttagtgatcaggtgtgagagtggccatttccttacctttgatccctgcaaagcagaaaggactcccttgacaaggaacagactaccgtggtgagcagaacgatttcctttttcaagacaatacccgcctggcttctctgaatctgtgctagccacgatattgccccaactccgctcccactgaagtgctccctaaggaacagcatttctctgctcgtcagtcaacccccatagcctagagcagtgtcacgagcttcagtaaggccaatcagctggaagtcagtgtaccatatagtaacactgtatttcagtttacagaccacactctagctgttttccataaaaggtatacaaataaagaattttttagcaaaacatgtttttaaccatcaatgctcaattgcattttcttcctttcgcagccagtcagtctttcgaactattgacagtgagataattctcgtgttcacacctggcggcaggcttcactatagggacggacattgcagttacaccgcgattcctttctcttcactggctcgaggtaaacactttccaaggaaaaacaactctaggatttcttttttctgtgtacgtagaccagtcccatcagtgtataatctctctctttcacgcctctctccaatagacagcttgtatttgcagtatttcatatttataaatgcgcgtttatttaaaaggagaacaaaagcttgactctgattcacagttttgtatgtagctggtttgacgtagtcttttgtattttccctgccgaagtgaattgttggagaatgtaaaccgcctccgtgcggcagcagacttcctaaggccccagctcgctagcctcgtgctgggcagctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccgggatgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttccgggggcgggccagctggcggtagatttgtgatgtcacagtgcaaactgcagcgactgtaaatcggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttcaaaaaaaa

SEQ ID NO: 26 - DNA, 4702 bp, Macaca mulatta
ttttttttgaaaatgaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccgatttacagtcgctgcagtttgcactgtgacatcacaaatctaccgccagctggcccgcccccggaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcatcccggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagctgcccagcacgaggctagcgagctggggccttaggaagtctgctgccgcacggaggcggtttacattctccaacaattcacttcggcagggaaaatacaaaagactacgtcaaaccagctacatacaaaactgtgaatcagagtcaagcttttgttctccttttaaataaacgcgcatttataaatatgaaatactgcaaatacaagctgtctattggagagaggcgtgaaagagagagattatacactgatgggactggtctacgtacacagaaaaaagaaatcctagagttgtttttccttggaaagtgtttacctcgagccagtgaagagaaaggaatcgcggtgtaactgcaatgtccgtccctatagtgaagcctgccgccaggtgtgaacacgagaattatctcactgtcaatagttcgaaagactgactggctgcgaaaggaagaaaatgcaattgagcattgatggttaaaaacatgttttgctaaaaaattctttatttgtataccttttatggaaaacagctagagtgtggtctgtaaactgaaatacagtgttactatatggtacactgacttccagctgattggccttactgaagctcgtgacactgctctaggctatgggggttgactgacgagcagagaaatgctgttccttagggagcacttcagtgggagcggagttggggcaatatcgtggctagcacagattcagagaagccaggcgggtattgtcttgaaaaaggaaatcgttctgctcaccacggtagtctgttccttgtcaagggagtcctttctgctttgcagggatcaaaggtaaggaaatggccactctcacacctgatcactaagctaaggggacatggcaaagggggccacccgaggggcggaggggaccaagtgacaactcaagccaccgtctgactcatctcccggagcagggaggaagtgttgtgttgacaaaactcttccatgtccacaaccaccgtgaggtactctgcaccctaagccagcagaggagcctctaagggctctgcgttcactggcttatgggggttctcagcaggacggagggctgcaagcaaagatctttaaatatcaccctgtgcctgtgacctctgcagcgtttccttgtctttatcaccatggaaacccacgagacacagcacgaagccaaccaggtgccattctctctttagatcctttaatcccccgagggacatcagccgtgaaacgactcacaccactgcagcagcaggggtaaggcagtgatcgttctagaacaggctgaaggccgtggaaacgcaaggctgaaagtacccaggtggattatgcagcatccaccgctggccgatgacgggtgccaggtgtgtctcaaggaggctggcccacgtcagtctagaggcgaggccattcagcctgctgtttgtggaacagtgaattttccaaaggaataaagtctcctgcactgtgcagaacaagacacgctaataacaagaggatctgacatctgagcatagagaaatgattaacagactgtggttgcttgactgagtccacaaaacatgccaaatgcctaccacagtgacaccttttattttaacagaaaagcttttcaagtatactgggaagggctgggtttgtcatttgggagctgaatccacaccgtggtatttggcagagggtgcggaggaccctctgggaacatttggggacccatactcagtttgaagtctgcccgttcgaaactctttctgtattatatgagttgaaacgccacatccccctcctaccataggctgaatacaatattgaaaacaaagaaggagtgcaaaaaagtgatcaatacaaaaaaagtaaacatatcagttttaattgtcaagattattccagggcaagagttcatttccaatcatttctctctggttcttgctcctaagcggcccaagccaaaatgatcattccagtttattttcaaatttccgctggatcttccaagccctccccaatttggccgacgcagagggaggcgaccctgctgggttcacagcagcaaatcgtcatttaagtccaacaaactagtcaatcttggttggctggcactgaacgaacccatctcgctttgggtccccaggtgcagaatcaatgtgtgttcttaaccaatgcacagaccgcttcttcagtccagtgttcacttcctccaatcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccatcatcctcgcaaggtaagatctggaaatttttaattttctggtgatgacacagtgtgagtacaaatgcctttggattactctggctgtcacggaggagaaaaagcccgtccacgagcccttgctgtttaatgatcctgtgggattcctccctggagatcctcccgtgaaaccagtgctgtgtcctgtgaatcactgtacttagggtagaagggtggaggggactttggctacctaggatgttcatccgtgtgcttcgcttcctccaggcgtggccctcctccagggctgcgctctgggcctccgccggattctctatcacgcgtcctgtttgcccagaaaaatccattgccacgagggagttctcggagacactgcgcactggcgttgagaacggggatagcaaggccttcctctgctgagggattcggtagttctggtaaaggagcattccatacttcaggagtctgaacgctgtcatccagcacgtcctggtttgctcatcctctgcacagagcaacctcagctctttagcttcattcctgactttgtttggctttatgcagagcccgtggtctgtaggggcgctgtactgcttcctgccggcgatcagggagaagatgttgctgtcctccaggtcggccagcagctgcaggtgtctgggttcctttgaagttcccttggtggagcaataaaggccagatctccgcaaacacacatacagctttttccatgatttctttcccagctctttcacatgcaaaaacccttgaatttcaggacagctactggagttcagaaaattctgcaaaagctggctttgactgccatttgactgctggcaccaagtaaccatctgttctgggaagaaattcatgggatttttaaagaactcgtattttgcataattcttcctgaatagaaatttactctcactggccatggtactctccacttggaccaccagctcgtggtcttccaagcacctctctaatcctaggtgcgggtggtgctccactagtgtccagctgttgtcatccacacagtgacttttgtaaaccagcaattggcacaggtccctggctgtcatgtctgctagaatctccaccactttgctcgtcccatcttcactaaagactttaacatcctgctttgcggcggcctggctcggaggtaaagaacccggcgtgagcacaggggggctcccagggccacagagttcaggaaaaggattcgggatggccggcagagacgaggttctaaattgctggtcttcctcctgaaggcgcctgacagcaagtatgtgcacaggctgggagcgctgcaccctctgcctcggggacacctgtggctggacggaccgagggcctgaagcccgaggttggctgcggtcatgctggccattctgcaggaggggcactgtgtctgactgcatgctgcaggctgagtacaggctatccagggatgcgttcatatcgttcaccagggcttccaggtccacatcatcctcctggtgatgtgtgagtcggtcagactgtgcggggagtcctggtcctgccgggtcttgttgactgcgaggtgtctgctccaccttgtcctggtagtacggatggtgcaaaaaggaatctgggcagccagctaaagccatgggttccttctgccttcttcaaat

SEQ ID NO: 27 - DNA, 4585 bp, Oryctolagus cuniculus
gcggcggcggcggcggcgcggggcgcccggcaccgtcctgtgcgcagcctcgcccgcggggacccgcgaccgccgccggccacgccgagggtcgcaggcggccacgcggagggaggagcggcgcctcggcagacctgcgggaaccagctcagagaccccagcggagacggccgtgtagctgacgaggccagcatggagcgcatgagaggacgcaggaaggatgacgacctggagaagctggtgaatgacatgaacacatccttggagagcctgtactcggcctgcagcaacatgcagtcggacacggtgcccctgctgcagaacggccagcacacccgcagcccgccgcctgccgcgagtgcccgccccgccccgccgcagaaggtgcagcgctcccagcctgtgcacatcctggccgtcagcaggcgccttcaggatgaagacccgcagttccgaacctcttcgctgccggccatccccaaccccttcccagagctcagcggccctgggagctccccggtgctcccgccggcctccctgcctccgagccagcccgtgacaaagcaggatgtcaaggtctttagtgaggatgggacaagcaaagtggtggagattctgacggacatgacagcccgggacctgtgccagctgctgatttacaggagtcactgcgtggatgacaacagctggaccctggtggaacaccacccacacctgggactcgagcggtgcttggaagaccatgagctggtggtgcaggtggagggcaccatgggaagtgagggcaaatttctgttcaggaagaattatgcgaaatacgagttcttcagaaaccctgtgaatttcttcccggaacaaatggtcacttggtgccagcagtccaatggaagtcatacgcagctgctgcagaacttcctgaacgccagcagctgccctgagattcaaggatttctgcacgtgaaggagctgggaagaaagtcgtggaagaggctgtatgtgtgcctgcgccggtctggcctctactgctccactaagggaacatccaaagaacccaggcacctgcagctgcttgctgacctggaggagagcaacatcttctccctgatttctgggaagaagcagtacagtgcacccacggaccacgggctctgcataaagccaaacaaagtgaggaatgaaatcaaggaactgcgactgctgtgtgcagaggatgagcaaagccgcatatgctggatgactgcgttccgtctccttaagtatggaatgctcctgtaccagaactatcgcatccctcagcagaggaaggccttgctggcaccctttgcaacaccagtgcgcagtgtctctgagaactctcttgtggcaatggatttttctgggcaaacaggaagagtcattgagaatccagctgaagcccagagtgctgccctggaggagggccatgcctggaggaagagaagcactcggatgaacatcttatctagccaaagtcccctccaccctaactccttcagcaccgtgatccacaggacccagcactggttccatgggaggatctccagggaggagtcccacaggatcatcaagcagcaagggcttgtggatgggcttttcctgcttcgtgacagccagagtaacccaaaggcatttgtactcacactgtgtcatcaccagaaaattaaaaacttccagatcttaccttgtgaggatgatgggcagaccttcctcagcctggatgacggcaacaccaggttctccgacctgatccagctggttgacttctaccagctgaacaaaggggtcctgccttgcaaactcaagcaccactgcatccgagtggccttatgacctcccacctggaggccgttcacactggaacgaggaagaggtctgcgcgtgtattgagaatatttctgtaccatcagatggttcctccggtaccagccaaccaggagggacttgtttgttgaattgacattttcctgccgcacacctggcgggaccatggccctttgttatcatccaaatcagaaagggcctgagaaatccagcgcaagttggaaaaataaactggaaagatcatcttggctgggccacatcagaacaagaaccggagagaaggaattggaaacgaactcttgccctggagtaatcttgacaattaaaactgatatgtttactttttttgtattgatcacttttttgcactccttctgtgttgtcagtgttgtattcagcctctggcaggagggacgtggctggtcagcctttgtgtaggagggacgtagctggtcagcctgtgtcagatgagcagagttgcgagtgggggtgggcgtcagactgaccgtgggtgccccagtgttcccataggtagctacgccctctctagattgccacaacatggattcagctcccagattacaaacaccccctgcccctaccccagcccttcccagtatacttgaaaagctttgtttttaaatatacaaggtgtcacctgtggtaggcgtttggcatgtttcgtggactggtctgtcattagccattgctctgtgcacaggtgtcccgtcctgttgttgtcagcgtgtctcattctccacgtgccgtggactctgtttctttggaaaactcactgtgccccagcacagcagggctgggcgatgccctccagcttagcacaggctggccttctcgggatgcgcccagcctgttgcgcagtccgtctggggaaatctcagcctcgcattttcccagccaccagcctgttctagaacagtcactgccttacccccttgcggtggtgtgagtcgtcctgtggctgatcccccttaggaggttaaagaagctgcagagaaaatggcaccaggtagctttctgctgtgctccgtgggtttccatggcggtgaagacagagccgttgcagagggcacaggcttgggctggctttccaaggtcagtggcctctgtcctgtgagcctgtggacgtgggcagtaatgcctcagtggctgtgggtgctggccagtggtagcaacaactcacttgcttcccactctgggagatgagtcagtcagaggctcaagttgtcactgggtccgctcctcccctggccttgtcttaaagtgtgagaggggctatttctgtacctttgactgccacagagcagaagggacagccctgacaagcccccacaccactggggtgaatagagtgactaccttgcccaaggtgacacctgaccggctctgctgagcccgtgctagccactggctcaccccagctcccttccacagcacgtcctggacctctggttgatgtgtgtgggtgagcacagacatgggagagctgtgctgagacaggctggctgccgcccgtccatggtatggaaacgctggactgtagttcccagagcacgctcctgttgtttccatgaaatgcctactcactgaaatgaagacttttgtagcaaagtgttatttttaaccataaatgctcagtggcctcttcttccttttgcacccagttaatctttggaacaattgacaacggggtgattgtcaagttagtggctggcggctgctgccgctgaccccactctgggagggctgtctcgttccccaccagacccttctttccctcactgaccccaccctggggagagctgtctccatccccaccagctggcaaaacctttacagacaactctagggtttctttgctctgtttctgtagacaacgcaacagcgccaaacccctccctcatgccgctccctgacggacagctaggatgtgcagtatttcatatttataagtgtgcgttctatttaaaagaagaacaaagcttggctctgactcacgattttgtatgtagctggtttgacgtagtcttttgtacctccccagcgtagtgaattgtggagagtgtagaccgccctgcccgcgtgcagcagacttctcgcggcccctggctgggaatcccacctggaaacagcaagtcccttgtgcctgtggtggcatatgcccccgggctgggacggaaggacatttgacttttatttttgtatttaattgacgtgaatgtaaaggggacagctcagggttgttgtggagcctgttgacctttttctctgcctgtgattttattttctgaatggaaactccattgtagcaacctggattaagtcgagaaggaaaacgccaaatgctttgggtgttgttagagttccagaatcttctttttgtttgctaaaccttgaagaaacatgtgcctcagcttaggtgttttgtcctctcctttctgcacttgacacctgacagtctgacccatcgctgcgccttgcgggctgggactagctccttatagatttgtgatgtggcagtgtcaccctgtgtgtcatcagttcagggactgcagaaggtgttgatgaggagacaaaacctttacccgcgtgctccgcttcattctgtacatagctctctggctcgtgaacctaactgtaaacgttcaggtatttttgtacaaataagggactgatgttctgtttcttgtaactagaaataaacattaatacagtgttcttcattttc

SEQ ID NO: 28 - DNA, 4585 bp, Oryctolagus cuniculus
gaaaatgaagaacactgtattaatgtttatttctagttacaagaaacagaacatcagtcccttatttgtacaaaaatacctgaacgtttacagttaggttcacgagccagagagctatgtacagaatgaagcggagcacgcgggtaaaggttttgtctcctcatcaacaccttctgcagtccctgaactgatgacacacagggtgacactgccacatcacaaatctataaggagctagtcccagcccgcaaggcgcagcgatgggtcagactgtcaggtgtcaagtgcagaaaggagaggacaaaacacctaagctgaggcacatgtttcttcaaggtttagcaaacaaaaagaagattctggaactctaacaacacccaaagcatttggcgttttccttctcgacttaatccaggttgctacaatggagtttccattcagaaaataaaatcacaggcagagaaaaaggtcaacaggctccacaacaaccctgagctgtcccctttacattcacgtcaattaaatacaaaaataaaagtcaaatgtccttccgtcccagcccgggggcatatgccaccacaggcacaagggacttgctgtttccaggtgggattcccagccaggggccgcgagaagtctgctgcacgcgggcagggcggtctacactctccacaattcactacgctggggaggtacaaaagactacgtcaaaccagctacatacaaaatcgtgagtcagagccaagctttgttcttcttttaaatagaacgcacacttataaatatgaaatactgcacatcctagctgtccgtcagggagcggcatgagggaggggtttggcgctgttgcgttgtctacagaaacagagcaaagaaaccctagagttgtctgtaaaggttttgccagctggtggggatggagacagctctccccagggtggggtcagtgagggaaagaagggtctggtggggaacgagacagccctcccagagtggggtcagcggcagcagccgccagccactaacttgacaatcaccccgttgtcaattgttccaaagattaactgggtgcaaaaggaagaagaggccactgagcatttatggttaaaaataacactttgctacaaaagtcttcatttcagtgagtaggcatttcatggaaacaacaggagcgtgctctgggaactacagtccagcgtttccataccatggacgggcggcagccagcctgtctcagcacagctctcccatgtctgtgctcacccacacacatcaaccagaggtccaggacgtgctgtggaagggagctggggtgagccagtggctagcacgggctcagcagagccggtcaggtgtcaccttgggcaaggtagtcactctattcaccccagtggtgtgggggcttgtcagggctgtcccttctgctctgtggcagtcaaaggtacagaaatagcccctctcacactttaagacaaggccaggggaggagcggacccagtgacaacttgagcctctgactgactcatctcccagagtgggaagcaagtgagttgttgctaccactggccagcacccacagccactgaggcattactgcccacgtccacaggctcacaggacagaggccactgaccttggaaagccagcccaagcctgtgccctctgcaacggctctgtcttcaccgccatggaaacccacggagcacagcagaaagctacctggtgccattttctctgcagcttctttaacctcctaagggggatcagccacaggacgactcacaccaccgcaagggggtaaggcagtgactgttctagaacaggctggtggctgggaaaatgcgaggctgagatttccccagacggactgcgcaacaggctgggcgcatcccgagaaggccagcctgtgctaagctggagggcatcgcccagccctgctgtgctggggcacagtgagttttccaaagaaacagagtccacggcacgtggagaatgagacacgctgacaacaacaggacgggacacctgtgcacagagcaatggctaatgacagaccagtccacgaaacatgccaaacgcctaccacaggtgacaccttgtatatttaaaaacaaagcttttcaagtatactgggaagggctggggtaggggcagggggtgtttgtaatctgggagctgaatccatgttgtggcaatctagagagggcgtagctacctatgggaacactggggcacccacggtcagtctgacgcccacccccactcgcaactctgctcatctgacacaggctgaccagctacgtccctcctacacaaaggctgaccagccacgtccctcctgccagaggctgaatacaacactgacaacacagaaggagtgcaaaaaagtgatcaatacaaaaaaagtaaacatatcagttttaattgtcaagattactccagggcaagagttcgtttccaattccttctctccggttcttgttctgatgtggcccagccaagatgatctttccagtttatttttccaacttgcgctggatttctcaggccctttctgatttggatgataacaaagggccatggtcccgccaggtgtgcggcaggaaaatgtcaattcaacaaacaagtccctcctggttggctggtaccggaggaaccatctgatggtacagaaatattctcaatacacgcgcagacctcttcctcgttccagtgtgaacggcctccaggtgggaggtcataaggccactcggatgcagtggtgcttgagtttgcaaggcaggacccctttgttcagctggtagaagtcaaccagctggatcaggtcggagaacctggtgttgccgtcatccaggctgaggaaggtctgcccatcatcctcacaaggtaagatctggaagtttttaattttctggtgatgacacagtgtgagtacaaatgcctttgggttactctggctgtcacgaagcaggaaaagcccatccacaagcccttgctgcttgatgatcctgtgggactcctccctggagatcctcccatggaaccagtgctgggtcctgtggatcacggtgctgaaggagttagggtggaggggactttggctagataagatgttcatccgagtgcttctcttcctccaggcatggccctcctccagggcagcactctgggcttcagctggattctcaatgactcttcctgtttgcccagaaaaatccattgccacaagagagttctcagagacactgcgcactggtgttgcaaagggtgccagcaaggccttcctctgctgagggatgcgatagttctggtacaggagcattccatacttaaggagacggaacgcagtcatccagcatatgcggctttgctcatcctctgcacacagcagtcgcagttccttgatttcattcctcactttgtttggctttatgcagagcccgtggtccgtgggtgcactgtactgcttcttcccagaaatcagggagaagatgttgctctcctccaggtcagcaagcagctgcaggtgcctgggttctttggatgttcccttagtggagcagtagaggccagaccggcgcaggcacacatacagcctcttccacgactttcttcccagctccttcacgtgcagaaatccttgaatctcagggcagctgctggcgttcaggaagttctgcagcagctgcgtatgacttccattggactgctggcaccaagtgaccatttgttccgggaagaaattcacagggtttctgaagaactcgtatttcgcataattcttcctgaacagaaatttgccctcacttcccatggtgccctccacctgcaccaccagctcatggtcttccaagcaccgctcgagtcccaggtgtgggtggtgttccaccagggtccagctgttgtcatccacgcagtgactcctgtaaatcagcagctggcacaggtcccgggctgtcatgtccgtcagaatctccaccactttgcttgtcccatcctcactaaagaccttgacatcctgctttgtcacgggctggctcggaggcagggaggccggcgggagcaccggggagctcccagggccgctgagctctgggaaggggttggggatggccggcagcgaagaggttcggaactgcgggtcttcatcctgaaggcgcctgctgacggccaggatgtgcacaggctgggagcgctgcaccttctgcggcggggcggggcgggcactcgcggcaggcggcgggctgcgggtgtgctggccgttctgcagcaggggcaccgtgtccgactgcatgttgctgcaggccgagtacaggctctccaaggatgtgttcatgtcattcaccagcttctccaggtcgtcatccttcctgcgtcctctcatgcgctccatgctggcctcgtcagctacacggccgtctccgctggggtctctgagctggttcccgcaggtctgccgaggcgccgctcctccctccgcgtggccgcctgcgaccctcggcgtggccggcggcggtcgcgggtccccgcgggcgaggctgcgcacaggacggtgccgggcgccccgcgccgccgccgccgccgc

SEQ ID NO: 29 - DNA, 2415 bp, Homo sapiens
gcagatagctcggccgcgcgtctcagccgccggggccccgagcgcaggcggcgaggccaccacacctgcagagcgctcgggctgcctagccggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggtgtgtggcgctgcccaggggaggggcgacgcccacgacctggcgccggccccctggctgcacgcgcgagcgctcctgccccttccggacgggacccgcggctgtgctgcagacaggagaaaaaagaaagatcttgatgttccggaaatgccatctattccaaacccttttcctgagctatgctgttctccatttacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattaccatgtgaaaagaatgtatttcacctgcaagttacaaaaaaatagtttgtgcattgcaaataagcaaagacttggattgactttacattcatcatttaaaattcattagttaaaattaaaccttaggaaaaaaatgacttggtgtgttcttgtgtgatttttacattgctataatattttcttcaaatatgcatatttaaaacatgtctcccttatttaccatatagcaacatcagaattctgaaacacaaaatatgaaataaattgggagtcaggaataattatttgtgcactaaatttcaattatactattttttaatgttaagaaatatgataataacttatcaattaaaagaaactatccacaacctgttaatgaaactaaaaactattttgaattatatattttccgggtttatgatcatcttaaaatgaaatcatattttgagatagtagctttaaaccattttgaaatatgttgattttttccaggtaatttaaaaatattattaaatagttaattataaaattta

SEQ ID NO: 30 - DNA, 2415 bp, Homo sapiens
taaattttataattaactatttaataatatttttaaattacctggaaaaaatcaacatatttcaaaatggtttaaagctactatctcaaaatatgatttcattttaagatgatcataaacccggaaaatatataattcaaaatagtttttagtttcattaacaggttgtggatagtttcttttaattgataagttattatcatatttcttaacattaaaaaatagtataattgaaatttagtgcacaaataattattcctgactcccaatttatttcatattttgtgtttcagaattctgatgttgctatatggtaaataagggagacatgttttaaatatgcatatttgaagaaaatattatagcaatgtaaaaatcacacaagaacacaccaagtcatttttttcctaaggtttaattttaactaatgaattttaaatgatgaatgtaaagtcaatccaagtctttgcttatttgcaatgcacaaactatttttttgtaacttgcaggtgaaatacattcttttcacatggtaatgttttcgcccttatttatggtcttttattatttttcttgagtccttttccttcaatagtttaataagtcacttctggcttgtctagagagcaatcctagcacaataatgtttcaacttgcaaggaagaacgcccttattgagttgatagaactccaccagctgtattagatctgtaaatcttgtgtggccatcatccagtgtgtggaacatttcaccgtcatcttctactggtataatttgaaagtgctttattttttgtccatgactcattgacagtacgaaagttttggggttactctgactatcccgtaccaagaaaactccatccacaagtccttgctgaataatcaatcgctgagcctcatctctagaaattttgtggtgaaaccatggctgggaccggtggatagccatgtttgtggcagagctctgtgaagaggcagtggggctaccgtgagtgcccaggcgtaaacatccttttttcctccaagcgagtccttcttcaaccgcaactgaaagggcttcagtgggattttctataactctgcttttctggcctgagaagtccattgctaccagggaattctctgatatacttctcataggtgatatgctctgtgaactgcagccacttctaccttgatatggatgcatataattctggtacagctgcatgccatacttaagcaatctaatcgcggtcacccagcacgtcctactctgctcttcttctgcacagagcattttcaggtctcggggccctcccgctttgttaggcttaaagcagaatccatagttagtcggtgctccatgtttttttttgcctgccagtgacacataaatatcactattgccaaattcgctgaaaaactgcaaatgccgcggttcctttgatgttcctttagtagaaaaatataaaccagatcttcttagaaaaaagtaaatttttttccaagacttctttccctgttctttcgcatgtaagaaaccatgaatttcaggatatgtgcttgaactcagaaacatctgcaaaatctgtgtgggggatatttcaccattggtttcagttgcaaaagataccatatgctctggaaaaaaatacattgggtttttaaagaactcatatttggcataattttttctaaagtatagtttgttttcttcttctatcccccagttggatagcacttcaatcaccagttcgtggtcttctattgttctttctacacctatgtgaggcaggtgctcaaaaagggtccagctgtggtcatcaatgtaatgattcttcaggatcaacagctgacaaacatctcgagccgttatgtcactgggtacatctaaagccctgctggtttcatcttcactgtatactttaatcacctgttttttccttgaatttgctttgggaaataggtctgctgacaacacagatgtaaatggagaacagcatagctcaggaaaagggtttggaatagatggcatttccggaacatcaagatctttcttttttctcctgtctgcagcacagccgcgggtcccgtccggaaggggcaggagcgctcgcgcgtgcagccagggggccggcgccaggtcgtgggcgtcgcccctcccctgggcagcgccacacacctgggcggccagcggcgaatcccgggcagccgccctgctcgcggcgctctgcccatcttgcagggaagtggtcattgtcgccggccggggggctcgggcgtcatgggagactcggcgcgtggggagaaggggtttgcgcggcgggaggcgaggtgccggctaggcagcccgagcgctctgcaggtgtggtggcctcgccgcctgcgctcggggccccggcggctgagacgcgcggccgagctatctgc

SEQ ID NO: 31 - DNA, 2099 bp, Homo sapiens
attactttcctagttgtttcattgcactgagccctgagattcccaaggagtaaccataaaagatttcttttattttgtccatgacctacgagacaggatcattctaagaagagcaggcatgagtttgagtgcaagaagagtcactctgcctgcaataacgccaataattctacagaaaagggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattaccatgtgaaaagaatgtatttcacctgcaagttacaaaaaaatagtttgtgcattgcaaataagcaaagacttggattgactttacattcatcatttaaaattcattagttaaaattaaaccttaggaaaaaaatgacttggtgtgttcttgtgtgatttttacattgctataatattttcttcaaatatgcatatttaaaacatgtctcccttatttaccatatagcaacatcagaattctgaaacacaaaatatgaaataaattgggagtcaggaataattatttgtgcactaaatttcaattatactattttttaatgttaagaaatatgataataacttatcaattaaaagaaactatccacaacctgttaatgaaactaaaaactattttgaattatatattttccgggtttatgatcatcttaaaatgaaatcatattttgagatagtagctttaaaccattttgaaatatgttgattttttccaggtaatttaaaaatattattaaatagttaattataaaattta

SEQ ID NO: 32 - DNA, 2099 bp, Homo sapiens
taaattttataattaactatttaataatatttttaaattacctggaaaaaatcaacatatttcaaaatggtttaaagctactatctcaaaatatgatttcattttaagatgatcataaacccggaaaatatataattcaaaatagtttttagtttcattaacaggttgtggatagtttcttttaattgataagttattatcatatttcttaacattaaaaaatagtataattgaaatttagtgcacaaataattattcctgactcccaatttatttcatattttgtgtttcagaattctgatgttgctatatggtaaataagggagacatgttttaaatatgcatatttgaagaaaatattatagcaatgtaaaaatcacacaagaacacaccaagtcatttttttcctaaggtttaattttaactaatgaattttaaatgatgaatgtaaagtcaatccaagtctttgcttatttgcaatgcacaaactatttttttgtaacttgcaggtgaaatacattcttttcacatggtaatgttttcgcccttatttatggtcttttattatttttcttgagtccttttccttcaatagtttaataagtcacttctggcttgtctagagagcaatcctagcacaataatgtttcaacttgcaaggaagaacgcccttattgagttgatagaactccaccagctgtattagatctgtaaatcttgtgtggccatcatccagtgtgtggaacatttcaccgtcatcttctactggtataatttgaaagtgctttattttttgtccatgactcattgacagtacgaaagttttggggttactctgactatcccgtaccaagaaaactccatccacaagtccttgctgaataatcaatcgctgagcctcatctctagaaattttgtggtgaaaccatggctgggaccggtggatagccatgtttgtggcagagctctgtgaagaggcagtggggctaccgtgagtgcccaggcgtaaacatccttttttcctccaagcgagtccttcttcaaccgcaactgaaagggcttcagtgggattttctataactctgcttttctggcctgagaagtccattgctaccagggaattctctgatatacttctcataggtgatatgctctgtgaactgcagccacttctaccttgatatggatgcatataattctggtacagctgcatgccatacttaagcaatctaatcgcggtcacccagcacgtcctactctgctcttcttctgcacagagcattttcaggtctcggggccctcccgctttgttaggcttaaagcagaatccatagttagtcggtgctccatgtttttttttgcctgccagtgacacataaatatcactattgccaaattcgctgaaaaactgcaaatgccgcggttcctttgatgttcctttagtagaaaaatataaaccagatcttcttagaaaaaagtaaatttttttccaagacttctttccctgttctttcgcatgtaagaaaccatgaatttcaggatatgtgcttgaactcagaaacatctgcaaaatctgtgtgggggatatttcaccattggtttcagttgcaaaagataccatatgctctggaaaaaaatacattgggtttttaaagaactcatatttggcataattttttctaaagtatagtttgttttcttcttctatcccccagttggatagcacttcaatcaccagttcgtggtcttctattgttctttctacacctatgtgaggcaggtgctcaaaaagggtccagctgtggtcatcaatgtaatgattcttcaggatcaacagctgacaaacatctcgagccgttatgtcactgggtacatctaaagccctgctggtttcatcttcactgtatactttaatcacccttttctgtagaattattggcgttattgcaggcagagtgactcttcttgcactcaaactcatgcctgctcttcttagaatgatcctgtctcgtaggtcatggacaaaataaaagaaatcttttatggttactccttgggaatctcagggctcagtgcaatgaaacaactaggaaagtaat

SEQ ID NO: 33 - DNA, 1978 bp, Mus musculus
gcggccctgccaccgcacctgcaaggcgctcgctgcctgcaaccgctcggctctgctcgcccccagcccttcgtagctttcgcctcgcggtcgatgactccctagacccctggcctacgaccatgaccacgtccctgcaagacgggcagagcgccgcgggccgggcaggcgcccaggattcgccgctggcagtgcaggtgtgccgcgttgcccagggcaagggagacgcccaggacccggcgcaggtccccggactgcacgcgctgtcccccgcctccgatgcgaccctccgcggtgccatagacaggagaaaaatgaaagatctggatgttctggaaaagccacccattcccaacccctttcctgagctctgctgctctccgcttacatctgtgctgtcagcaggcctgtttcccagggccaattcaaggaagaagcaggtgattaaagtttacagcgaggatgaaaccagcagagcattagaggtgcccagtgacatcacagcccgagatgtttgccagctgttgatcctgaagaaccactatgtggacgacaacagctggaccctttttgagcacctatctcacataggtttagaaagaaccgtagaggaccacgagctgccaactgaagtgctgtctcactggggagtggaagaagacaataagctgtatcttagaaagaattatgccaaatatgaattttttaagaacccaatgtatttctttccagagcacatggtgtcttttgcagctgaaatgaatggtgacagatcccctacacagatactgcaggtgtttttaagctccagcacgtatcctgaaatccatggcttcttacatgcaaaggaacagggaaagaagtcttggaaaaaagcttacttttttctcagaagatctggcttatatttttctactaaaggcacatccaaggaaccacggcatttgcagcttttcagtgaattcagcactagtcacgtttatatgtcactggcaggaaaaaaaaaacacggagcgccaactccctatggattctgcttaaagcctaacaaagcaggagggccccgggacctgaaaatgctctgtgcagaagaagagcagagcaggacgtgctgggtgaccgccatccgactgctgaaggatggcatgcagctgtatcagaattatatgcatccataccaaggtagaagcgcctgcaattctcagagcatgtcacccatgagaagcgtatcagagaattccctagtagcaatggacttctcaggtgagaagagcagagtcatagacaaccccactgaagcgctttcggttgctgttgaggaaggcctcgcgtggaggaaaaaaggctgtttacgcctggggaatcacggaagccccagtgccccctcccagagctctgctgtgaacatggctctccatcggtcccaaccatggtttcaccacagaatttccagagatgaggctcagcggctgatcattcggcaggggcctgtggatggagttttcttggtacgggatagtcagagtaaccccagaacttttgtactgtcaatgagtcatggacaaaagataaaacactatcaaattatacccgtagaagatgatggtgagctgttccatactctggatgatggccatacgaagttcacagacctcatccagctggtggagttctaccagctcaacaggggggtccttccttgcaagctgaagcattactgtgctaggatggctgtttagccaaactgtgtgtcactcgttacactacagaagaagaaggatgcaaaggagaatgattagagagagagagagagatcacaaggctgaaaacaaatcatggtgaaaagaagatttcacctgcgggttacaaaaaaaaataggtcacacattgcaaattagtgaaaacttggattcctattacactcatgactttaaatttattagttaaaattaaaccttattaaaaaaaaaaaaaaaaa

SEQ ID NO: 34 - DNA, 1978 bp, Mus musculus
tttttttttttttttttaataaggtttaattttaactaataaatttaaagtcatgagtgtaataggaatccaagttttcactaatttgcaatgtgtgacctatttttttttgtaacccgcaggtgaaatcttcttttcaccatgatttgttttcagccttgtgatctctctctctctctctaatcattctcctttgcatccttcttcttctgtagtgtaacgagtgacacacagtttggctaaacagccatcctagcacagtaatgcttcagcttgcaaggaaggacccccctgttgagctggtagaactccaccagctggatgaggtctgtgaacttcgtatggccatcatccagagtatggaacagctcaccatcatcttctacgggtataatttgatagtgttttatcttttgtccatgactcattgacagtacaaaagttctggggttactctgactatcccgtaccaagaaaactccatccacaggcccctgccgaatgatcagccgctgagcctcatctctggaaattctgtggtgaaaccatggttgggaccgatggagagccatgttcacagcagagctctgggagggggcactggggcttccgtgattccccaggcgtaaacagccttttttcctccacgcgaggccttcctcaacagcaaccgaaagcgcttcagtggggttgtctatgactctgctcttctcacctgagaagtccattgctactagggaattctctgatacgcttctcatgggtgacatgctctgagaattgcaggcgcttctaccttggtatggatgcatataattctgatacagctgcatgccatccttcagcagtcggatggcggtcacccagcacgtcctgctctgctcttcttctgcacagagcattttcaggtcccggggccctcctgctttgttaggctttaagcagaatccatagggagttggcgctccgtgttttttttttcctgccagtgacatataaacgtgactagtgctgaattcactgaaaagctgcaaatgccgtggttccttggatgtgcctttagtagaaaaatataagccagatcttctgagaaaaaagtaagcttttttccaagacttctttccctgttcctttgcatgtaagaagccatggatttcaggatacgtgctggagcttaaaaacacctgcagtatctgtgtaggggatctgtcaccattcatttcagctgcaaaagacaccatgtgctctggaaagaaatacattgggttcttaaaaaattcatatttggcataattctttctaagatacagcttattgtcttcttccactccccagtgagacagcacttcagttggcagctcgtggtcctctacggttctttctaaacctatgtgagataggtgctcaaaaagggtccagctgttgtcgtccacatagtggttcttcaggatcaacagctggcaaacatctcgggctgtgatgtcactgggcacctctaatgctctgctggtttcatcctcgctgtaaactttaatcacctgcttcttccttgaattggccctgggaaacaggcctgctgacagcacagatgtaagcggagagcagcagagctcaggaaaggggttgggaatgggtggcttttccagaacatccagatctttcatttttctcctgtctatggcaccgcggagggtcgcatcggaggcgggggacagcgcgtgcagtccggggacctgcgccgggtcctgggcgtctcccttgccctgggcaacgcggcacacctgcactgccagcggcgaatcctgggcgcctgcccggcccgcggcgctctgcccgtcttgcagggacgtggtcatggtcgtaggccaggggtctagggagtcatcgaccgcgaggcgaaagctacgaagggctgggggcgagcagagccgagcggttgcaggcagcgagcgccttgcaggtgcggtggcagggccgc

SEQ ID NO: 35 - DNA, 1950 bp, Rattus norvegicus
gctggaccccagcctttcttcgctttcgcctcgcggtcgatgactccctagaccccctggcctacgatcatgaccacgtccctgcaagatgggcagagcgccgcgggccgggcgggcgcccaggactccccgctggcagtgcaggtgtgccgcgttgcccagggcaagggagacgcccaggacccggctcaggtccccggactgcacgcgctgtccccggcctcagatgcgacccgccgcggtgccatggacaggagaaaagcgaaagatctggaagttcaggaaacgccttccattcctaaccccttccctgagctctgctgttctccacttacatcggtgctgtcagcaggcctcttccccagatcaaattcaaggaagaaacaggtgattaaagtttacagcgaggatgagaccagcagagcgttagaggtgcccagtgacgtcacagcccgtgatgtctgccagctgttgatcctgaagaaccactatgtcgacgacaatagctggaccctttttgagcacctgtctcacacaggcgtagaaaggacagtggaggaccatgagctgctgactgaagtgctgtctcattgggtgatggaagaagataataagctgtatcttagaaagaattatgccaaatatgaattttttaagaacccaatgtatttctttccagagcacatggtgtcttttgcaactgaaatgaacggtgacagatcccttacacagatcccgcaggtgtttttaagctcaaacacatatcctgaaatccatggcttcctgcatgcaaaggaacaggggaagaagtcttggaaaaaagcttacttttttctcagaagatctggtttatatttttctactaaaggcacatccaaggaaccacggcacttgcagtttttcagtgaattcagcactagtaatgtttacatgtcactggcaggcaaaaaaaagcatggagcgccgactccctatggattctgctttaagcctaccaaagcaggagggccccgggacctgaaaatgctgtgtgcagaagaagaccaaagcaggatgtgctgggtgaccgccattagattgctcaagtatggcatgcagctctaccagaattatatgcatccatcccaagctagaagcgcctgcagttctcagagcgtatcacccatgagaagcgtatcagagaattccctagtagcaatggacttctcaggtcagaagaccagagtcatagacaaccccactgaagccctttcggttgccgttgaggaaggactcgcttggaggaaaaaaggatgtttacgcctggggaatcatgggagtcccactgcgccctctcagagctctgctgtgaacatggctctccaccggtcccagccatggtttcaccacagaatttctagagatgaagctcagcagttgattacccggcaggggcctgtggatggagttttcttggtacgggatagtcagagtaaccccagaacttttgtactgtcaatgagtcacggacaaaagataaaacactttcaaattatacccgtggaagatgatggtgaggtgttccacaccctggatgatggccatacgaagttcacagatctcatccagctcgtggagttctaccagctcaacaagggggtccttccttgcaagctgaagcattactgtgctaggatggctgtttagccaaactgtctgtgactcgttaaactatggaagatggaggatgcaaagaagaatgattagagagagagagagagagagagagagagagagagagagagagagagagagaggagatcacaaggctggaaacaaatcatggtgaaaagaagattcacctgtgggttacaaaaaaataggtcacgtattgcaaattagtgaagacttggattcgtattactctcgttactttaaatttattagttaaaattaaaccttattaaaaaa

SEQ ID NO: 36 - DNA, 1950 bp, Rattus norvegicus
ttttttaataaggtttaattttaactaataaatttaaagtaacgagagtaatacgaatccaagtcttcactaatttgcaatacgtgacctatttttttgtaacccacaggtgaatcttcttttcaccatgatttgtttccagccttgtgatctcctctctctctctctctctctctctctctctctctctctctctctctctctctaatcattcttctttgcatcctccatcttccatagtttaacgagtcacagacagtttggctaaacagccatcctagcacagtaatgcttcagcttgcaaggaaggacccccttgttgagctggtagaactccacgagctggatgagatctgtgaacttcgtatggccatcatccagggtgtggaacacctcaccatcatcttccacgggtataatttgaaagtgttttatcttttgtccgtgactcattgacagtacaaaagttctggggttactctgactatcccgtaccaagaaaactccatccacaggcccctgccgggtaatcaactgctgagcttcatctctagaaattctgtggtgaaaccatggctgggaccggtggagagccatgttcacagcagagctctgagagggcgcagtgggactcccatgattccccaggcgtaaacatccttttttcctccaagcgagtccttcctcaacggcaaccgaaagggcttcagtggggttgtctatgactctggtcttctgacctgagaagtccattgctactagggaattctctgatacgcttctcatgggtgatacgctctgagaactgcaggcgcttctagcttgggatggatgcatataattctggtagagctgcatgccatacttgagcaatctaatggcggtcacccagcacatcctgctttggtcttcttctgcacacagcattttcaggtcccggggccctcctgctttggtaggcttaaagcagaatccatagggagtcggcgctccatgcttttttttgcctgccagtgacatgtaaacattactagtgctgaattcactgaaaaactgcaagtgccgtggttccttggatgtgcctttagtagaaaaatataaaccagatcttctgagaaaaaagtaagcttttttccaagacttcttcccctgttcctttgcatgcaggaagccatggatttcaggatatgtgtttgagcttaaaaacacctgcgggatctgtgtaagggatctgtcaccgttcatttcagttgcaaaagacaccatgtgctctggaaagaaatacattgggttcttaaaaaattcatatttggcataattctttctaagatacagcttattatcttcttccatcacccaatgagacagcacttcagtcagcagctcatggtcctccactgtcctttctacgcctgtgtgagacaggtgctcaaaaagggtccagctattgtcgtcgacatagtggttcttcaggatcaacagctggcagacatcacgggctgtgacgtcactgggcacctctaacgctctgctggtctcatcctcgctgtaaactttaatcacctgtttcttccttgaatttgatctggggaagaggcctgctgacagcaccgatgtaagtggagaacagcagagctcagggaaggggttaggaatggaaggcgtttcctgaacttccagatctttcgcttttctcctgtccatggcaccgcggcgggtcgcatctgaggccggggacagcgcgtgcagtccggggacctgagccgggtcctgggcgtctcccttgccctgggcaacgcggcacacctgcactgccagcggggagtcctgggcgcccgcccggcccgcggcgctctgcccatcttgcagggacgtggtcatgatcgtaggccagggggtctagggagtcatcgaccgcgaggcgaaagcgaagaaaggctggggtccagc

SEQ ID NO: 37 - DNA, 2531 bp, Macaca mulatta
aagaagaggcacgtggggaaggactggggcaaacccagccccctggtgccctggcctcctgccctcctggcccggtagggactgtcatggcggcccagcaacagcttaggtgatctcagatggcagagcaggaagaatgcaagggtatgagggtcagggctgcgcagacccctgtcccgcctgcggtcctcccggcaagcccagggggagagcccgctctgctgggtctccgcctccagcggcgccgggccgcccagaccctgggctcagtcttgcgccccggtgcccacctggggaggcggcggtcccggcctcgcgtcccggatcggacggcgcgggagcgatgccagcggccccgagcgccccgggccacgcgcggggccggccggacgctctcgcgccctcccagccccctccgcggctcgccccgccgcccgcggcccccacccaccggccgctcctcccctctccccaccctcctcctccgccccctcccctcccccgccgcctcgcagattgctcggcagcgtgtctcagccgccggggctccgagcgcaggctgcgaggccaccacacctgcagagcgctcgggctgcctagccggcacctcgcctccggccgcgcggtccccttctccccacgcgccgagtgtcccatgacgcccgagccccccggccggcgacaatgaccacttccctgcaagatgggcagagcgccgcgggcagggcggctgcccgggattcgccgctggccgcccaggtgtgcggcgctgcccaggggaggggcgacgcccacgacctggcgcccggcccctggctgcacgcgggagcgctcctgccccctccggacgggacccgcggctgtgctgcagacaggagaaaaaagaaagatcttgatgttccggaaatgccatctattccaaacccttttcctgagctatgctgttctccatttacatctgtgttgtcagcagacctgtttcccaaagcaaattcaaggaaaaaacaggtgattaaagtgtacagtgaagatgaaaccagtagggctttagatgtacccagtgacataacggctcgagatgtttgtcagctgttgatcctgaagaatcattacattgatgaccacagctggaccctttttgagcacctgcctcacataggtgtagaaagaacaatagaagaccatgaactggtgattgaagtgctatccaactgggggatagaagaagaaaacaagctatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacataccctgaaattcatggtttcttacatgcgaaagaacagggaaagaagtcttggaaaaaaatttacttttttctaagaagatctggtttatatttttctactaaagggacatcaaaggaaccgcggcatttgcagtttttcagcgaatttggcaatagtgatatttatgtgtcactggcaggcaaaaaaaagcatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcagttgaagagggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacaactggtggagttctatcaactcaataagggcgttcttccttgcaagttgaaacattattgtgctaggattgctctctagctaaaccagaagtgacttattaaactattgaagaaaaaggactcaagaaaaataataaaagaccataaataagggtgaaaatgttaccatgtgaaaagaatgtattttacctgcaagttacaaaaaaaatagtttgtgcattgcaaataagcaaagacttggattgactttacattcatcatttaaaattcattagttaaaattaaaccttagaaaaaaattga

SEQ ID NO: 38 - DNA, 2531 bp, Macaca mulatta; identical to SEQ ID NO: 37

SEQ ID NO: 39 - DNA, 1634 bp, Macaca mulatta
ttgccatgcacgtgaatgtcagacaatgaagaggaaggccatatgaatactatgtgtctagtggctgatgctggccacagacttggatcccagcctggtggtacccaagaggtgattaaagtgtacagtgaagatgaaaccagtagggctttagatgtacccagtgacataacggctcgagatgtttgtcagctgttgatcctgaagaatcattacattgatgaccacagctggaccctttttgagcacctgcctcacataggtgtagaaagaacaatagaagaccatgaactggtgattgaagtgctatccaactgggggatagaagaagaaaacaagctatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacataccctgaaattcatggtttcttacatgcgaaagaacagggaaagaagtcttggaaaaaaatttacttttttctaagaagatctggtttatatttttctactaaagggacatcaaaggaaccgcggcatttgcagtttttcagcgaatttggcaatagtgatatttatgtgtcactggcaggcaaaaaaaagcatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcagttgaagagggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacaactggtggagttctatcaactcaataagggcgttcttccttgcaagttgaaacattattgtgctaggattgctctctagctaaaccagaagtgacttattaaactattgaagaaaaaggactcaagaaaaataataaaagaccataaataagggtgaaaatgttaccatgtgaaaagaatgtattttacctgcaagttacaaaaaaaatagtttgtgcattgcaaataagcaaagacttggattgactttacattcatcatttaaaattcattagttaaaattaaaccttagaaaaaaattga

SEQ ID NO: 40 - DNA, 1634 bp, Macaca mulatta
tcaatttttttctaaggtttaattttaactaatgaattttaaatgatgaatgtaaagtcaatccaagtctttgcttatttgcaatgcacaaactattttttttgtaacttgcaggtaaaatacattcttttcacatggtaacattttcacccttatttatggtcttttattatttttcttgagtcctttttcttcaatagtttaataagtcacttctggtttagctagagagcaatcctagcacaataatgtttcaacttgcaaggaagaacgcccttattgagttgatagaactccaccagttgtattagatctgtaaatcttgtgtggccatcatccagtgtgtggaacatttcaccgtcatcttctactggtataatttgaaagtgctttattttttgtccatgactcattgacagtacgaaagttttggggttactctgactatcccgtaccaagaaaactccatccacaagtccttgctgaataatcaatcgctgagcctcatctctagaaattttgtggtgaaaccatggctgggaccggtggatagccatgtttgtggcagagctctgtgaagaggcagtggggctaccgtgagtgcccaggcgtaaacatccttttttcctccaagcgagtccctcttcaactgcaactgaaagggcttcagtgggattttctataactctgcttttctggcctgagaagtccattgctaccagggaattctctgatatacttctcataggtgatatgctctgtgaactgcagccacttctaccttgatatggatgcatataattctggtacagctgcatgccatacttaagcaatctaatcgcggtcacccagcacgtcctactctgctcttcttctgcacagagcattttcaggtctcggggccctcccgctttgttaggcttaaagcagaatccatagttagtcggtgctccatgcttttttttgcctgccagtgacacataaatatcactattgccaaattcgctgaaaaactgcaaatgccgcggttcctttgatgtccctttagtagaaaaatataaaccagatcttcttagaaaaaagtaaatttttttccaagacttctttccctgttctttcgcatgtaagaaaccatgaatttcagggtatgtgcttgaactcagaaacatctgcaaaatctgtgtgggggatatttcaccattggtttcagttgcaaaagataccatatgctctggaaaaaaatacattgggtttttaaagaactcatatttggcataattttttctaaagtatagcttgttttcttcttctatcccccagttggatagcacttcaatcaccagttcatggtcttctattgttctttctacacctatgtgaggcaggtgctcaaaaagggtccagctgtggtcatcaatgtaatgattcttcaggatcaacagctgacaaacatctcgagccgttatgtcactgggtacatctaaagccctactggtttcatcttcactgtacactttaatcacctcttgggtaccaccaggctgggatccaagtctgtggccagcatcagccactagacacatagtattcatatggccttcctcttcattgtctgacattcacgtgcatggcaa

SEQ ID NO: 41 - DNA, 1742 bp, Macaca mulatta
ccttaattggctttgggtagattggaatcacataagcagggtgacatttattactttcctagttgtttcattgcactgagccctgagattcctgtaaaagatttcttttattttgtccatgacctacaagagaggatcattctaagaagagcaggcatgagtttgagtgcaagaagagtcactctgcctgcaataacgccaataattctacagaaaagggtgattaaagtgtacagtgaagatgaaaccagtagggctttagatgtacccagtgacataacggctcgagatgtttgtcagctgttgatcctgaagaatcattacattgatgaccacagctggaccctttttgagcacctgcctcacataggtgtagaaagaacaatagaagaccatgaactggtgattgaagtgctatccaactgggggatagaagaagaaaacaagctatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacataccctgaaattcatggtttcttacatgcgaaagaacagggaaagaagtcttggaaaaaaatttacttttttctaagaagatctggtttatatttttctactaaagggacatcaaaggaaccgcggcatttgcagtttttcagcgaatttggcaatagtgatatttatgtgtcactggcaggcaaaaaaaagcatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcagttgaagagggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacaactggtggagttctatcaactcaataagggcgttcttccttgcaagttgaaacattattgtgctaggattgctctctagctaaaccagaagtgacttattaaactattgaagaaaaaggactcaagaaaaataataaaagaccataaataagggtgaaaatgttaccatgtgaaaagaatgtattttacctgcaagttacaaaaaaaatagtttgtgcattgcaaataagcaaagacttggattgactttacattcatcatttaaaattcattagttaaaattaaaccttagaaaaaaattga

SEQ ID NO: 42 - DNA, 1742 bp, Macaca mulatta
tcaatttttttctaaggtttaattttaactaatgaattttaaatgatgaatgtaaagtcaatccaagtctttgcttatttgcaatgcacaaactattttttttgtaacttgcaggtaaaatacattcttttcacatggtaacattttcacccttatttatggtcttttattatttttcttgagtcctttttcttcaatagtttaataagtcacttctggtttagctagagagcaatcctagcacaataatgtttcaacttgcaaggaagaacgcccttattgagttgatagaactccaccagttgtattagatctgtaaatcttgtgtggccatcatccagtgtgtggaacatttcaccgtcatcttctactggtataatttgaaagtgctttattttttgtccatgactcattgacagtacgaaagttttggggttactctgactatcccgtaccaagaaaactccatccacaagtccttgctgaataatcaatcgctgagcctcatctctagaaattttgtggtgaaaccatggctgggaccggtggatagccatgtttgtggcagagctctgtgaagaggcagtggggctaccgtgagtgcccaggcgtaaacatccttttttcctccaagcgagtccctcttcaactgcaactgaaagggcttcagtgggattttctataactctgcttttctggcctgagaagtccattgctaccagggaattctctgatatacttctcataggtgatatgctctgtgaactgcagccacttctaccttgatatggatgcatataattctggtacagctgcatgccatacttaagcaatctaatcgcggtcacccagcacgtcctactctgctcttcttctgcacagagcattttcaggtctcggggccctcccgctttgttaggcttaaagcagaatccatagttagtcggtgctccatgcttttttttgcctgccagtgacacataaatatcactattgccaaattcgctgaaaaactgcaaatgccgcggttcctttgatgtccctttagtagaaaaatataaaccagatcttcttagaaaaaagtaaatttttttccaagacttctttccctgttctttcgcatgtaagaaaccatgaatttcagggtatgtgcttgaactcagaaacatctgcaaaatctgtgtgggggatatttcaccattggtttcagttgcaaaagataccatatgctctggaaaaaaatacattgggtttttaaagaactcatatttggcataattttttctaaagtatagcttgttttcttcttctatcccccagttggatagcacttcaatcaccagttcatggtcttctattgttctttctacacctatgtgaggcaggtgctcaaaaagggtccagctgtggtcatcaatgtaatgattcttcaggatcaacagctgacaaacatctcgagccgttatgtcactgggtacatctaaagccctactggtttcatcttcactgtacactttaatcacccttttctgtagaattattggcgttattgcaggcagagtgactcttcttgcactcaaactcatgcctgctcttcttagaatgatcctctcttgtaggtcatggacaaaataaaagaaatcttttacaggaatctcagggctcagtgcaatgaaacaactaggaaagtaataaatgtcaccctgcttatgtgattccaatctacccaaagccaattaagg

SEQ ID NO: 43 - DNA, 2047 bp, Oryctolagus cuniculus
tccgccccctcccctcccccgccgcctcgcagactgctcagccgagctgctgagccgccggggccggagcgcaggcggccaggccaccgcacctgcagggcgctcgggccgccgagccggcatcccgcctcccgcctcccgacaccccgcagcctaggcgcccgggctcccatgccgcctgagcccccgggccggcaaccatgaccacttccctgcaagatgggcagagcgccgcggacagggcggctgcccgggactcgccgctggccgcccaggtgtgcggcgctgcccagggaagggacgacgcccacgacccggcgcgggccccctggctgcacgcgcgagctctggtgccggctccggacgggacccgcggctgtgctgcagacaggagaaaaaagaaagatcttgatgttctggaaacgccatctattccaaacccctttcctgagctctgctgttctccatttacatctgtgttgtcagcaggcctctttcccaaagcaaattcaaggaaaaaacaggtgattaaagtgtacagtgaagatgaaaccagcagggctctagaggttcccagtgacataacagcccgagatgtttgccagttgttgattctaaagaatcattacgtcgatgaccacagctggacactctttgagcatctgcctcacataggtgtagaaagaataatagaagaccatgagctagtgaccgaagtgctatccaactggggaatggaagaagaaaataagttattctttcgaaaaaattatgccaaatatgaattctttaaaaatccaatgtatttttttccagagcatatggtgtcttttgcaactgaaaccaatggtgaaatttcccccacacagattttacagatgtttctgagttcaactacatatcctgaaatccatggcttcttacatgcaaaagaacagggaaagaagtcctggaaaaaaatttacttccttctgagaagatctggtttatatttttctactaaagggacatcaaaggaaccacgacatttgcagtttttcagcgaatttggcagtagtgatatatatgtgtcactgacaggcagaaaaaaacacggagcaccgactcactatggattctgctttaagcctaacaaagcaggagggccccgagacctgaaaatgctctgtgcagaagaagagcagagcaggacgtgctgggtgactgccattcgattacttaagtatggcatgcagctctaccagaattatatgcatccatatcaaggtagaagtggctgcagttctcagagtatatcacccatgaggagtatatcagagaattctctggtagcaatggacttctcaggtcagaaaagcagagttatcgaaaatcccacagaagccctttcagttgcagtcgaagaaggacttgcttggaggaaaaaaggatgtttacgccttggcgtccatggtagccccactgcttcttcgcagagcagtgccgcaaacatggctatccaccgctcccaaccctggtttcaccacaaaatttctagagatgaagctcagcgactgattattcagcaaggacttgtagatggagttttcttggtacgggatagtcagagtaaccccaaaacttttgtactatcaatgagtcatggacaaaaaataaagcactttcaaattataccaattgaagatgatggtgcaatgttccatacactggatgatggccacacaagatttacagatctaattcaactggtggagttctatcaactcaataagggtgttcttccttgcaagttgaagcattattgtgctaggatggctctttaaccaaaccagaagtgacttgtgaaactattgaaggaaaaagaactcaagaagaaaattaagagagagaccataaataagggtgaaaatgttaaccatggggaaaagaatgtatttcatctcaagttacaagaaagagttatacattgcaaataagcaaagacttggattgacattatattcatcatttaaagttcattagttaaaaattaaactttaggaaaaaa

SEQ ID NO: 44 - DNA, 2047 bp, Oryctolagus cuniculus
ttttttcctaaagtttaatttttaactaatgaactttaaatgatgaatataatgtcaatccaagtctttgcttatttgcaatgtataactctttcttgtaacttgagatgaaatacattcttttccccatggttaacattttcacccttatttatggtctctctcttaattttcttcttgagttctttttccttcaatagtttcacaagtcacttctggtttggttaaagagccatcctagcacaataatgcttcaacttgcaaggaagaacacccttattgagttgatagaactccaccagttgaattagatctgtaaatcttgtgtggccatcatccagtgtatggaacattgcaccatcatcttcaattggtataatttgaaagtgctttattttttgtccatgactcattgatagtacaaaagttttggggttactctgactatcccgtaccaagaaaactccatctacaagtccttgctgaataatcagtcgctgagcttcatctctagaaattttgtggtgaaaccagggttgggagcggtggatagccatgtttgcggcactgctctgcgaagaagcagtggggctaccatggacgccaaggcgtaaacatccttttttcctccaagcaagtccttcttcgactgcaactgaaagggcttctgtgggattttcgataactctgcttttctgacctgagaagtccattgctaccagagaattctctgatatactcctcatgggtgatatactctgagaactgcagccacttctaccttgatatggatgcatataattctggtagagctgcatgccatacttaagtaatcgaatggcagtcacccagcacgtcctgctctgctcttcttctgcacagagcattttcaggtctcggggccctcctgctttgttaggcttaaagcagaatccatagtgagtcggtgctccgtgtttttttctgcctgtcagtgacacatatatatcactactgccaaattcgctgaaaaactgcaaatgtcgtggttcctttgatgtccctttagtagaaaaatataaaccagatcttctcagaaggaagtaaatttttttccaggacttctttccctgttcttttgcatgtaagaagccatggatttcaggatatgtagttgaactcagaaacatctgtaaaatctgtgtgggggaaatttcaccattggtttcagttgcaaaagacaccatatgctctggaaaaaaatacattggatttttaaagaattcatatttggcataattttttcgaaagaataacttattttcttcttccattccccagttggatagcacttcggtcactagctcatggtcttctattattctttctacacctatgtgaggcagatgctcaaagagtgtccagctgtggtcatcgacgtaatgattctttagaatcaacaactggcaaacatctcgggctgttatgtcactgggaacctctagagccctgctggtttcatcttcactgtacactttaatcacctgttttttccttgaatttgctttgggaaagaggcctgctgacaacacagatgtaaatggagaacagcagagctcaggaaaggggtttggaatagatggcgtttccagaacatcaagatctttcttttttctcctgtctgcagcacagccgcgggtcccgtccggagccggcaccagagctcgcgcgtgcagccagggggcccgcgccgggtcgtgggcgtcgtcccttccctgggcagcgccgcacacctgggcggccagcggcgagtcccgggcagccgccctgtccgcggcgctctgcccatcttgcagggaagtggtcatggttgccggcccgggggctcaggcggcatgggagcccgggcgcctaggctgcggggtgtcgggaggcgggaggcgggatgccggctcggcggcccgagcgccctgcaggtgcggtggcctggccgcctgcgctccggccccggcggctcagcagctcggctgagcagtctgcgaggcggcgggggaggggagggggcgga

SEQ ID NO: 45 - DNA, 1972 bp, Oryctolagus cuniculus
tccgccccctcccctcccccgccgcctcgcagactgctcagccgagctgctgagccgccggggccggagcgcaggcggccaggccaccgcacctgcagggcgctcgggccgccgagccggcatcccgcctcccgcctcccgacaccccgcagcctaggcgcccgggctcccatgccgcctgagcccccgggccggcaaccatgaccacttccctgcaagatgggcagagcgccgcggacagggcggctgcccgggactcgccgctggccgcccaggtgtgcggcgctgcccagggaagggacgacgcccacgacccggcgcgggccccctggctgcacgcgcgagctctggtgccggctccggacgggacccgcggctgtgctgcagacaggagaaaaaagaaagatcttgatgttctggaaacgccatctattccaaacccctttcctgagctctgctgttctccatttacatctgtgttgtcagcaggcctctttcccaaagcaaattcaaggaaaaaacaggtgattaaagtgtacagtgaagatgaaaccagcagggctctagaggttcccagtgacataacagcccgagatgtttgccagttgttgattctaaagaatcattacgtcgatgaccacagctggacactctttgagcatctgcctcacataggtgtagaaagaataatagaagaccatgagctagtgaccgaagtgctatccaactggggaatggaagaagaaaataagttattctttcgaaaaaattatgccaaatatgaattctttaaaaatccaatgatgtttctgagttcaactacatatcctgaaatccatggcttcttacatgcaaaagaacagggaaagaagtcctggaaaaaaatttacttccttctgagaagatctggtttatatttttctactaaagggacatcaaaggaaccacgacatttgcagtttttcagcgaatttggcagtagtgatatatatgtgtcactgacaggcagaaaaaaacacggagcaccgactcactatggattctgctttaagcctaacaaagcaggagggccccgagacctgaaaatgctctgtgcagaagaagagcagagcaggacgtgctgggtgactgccattcgattacttaagtatggcatgcagctctaccagaattatatgcatccatatcaaggtagaagtggctgcagttctcagagtatatcacccatgaggagtatatcagagaattctctggtagcaatggacttctcaggtcagaaaagcagagttatcgaaaatcccacagaagccctttcagttgcagtcgaagaaggacttgcttggaggaaaaaaggatgtttacgccttggcgtccatggtagccccactgcttcttcgcagagcagtgccgcaaacatggctatccaccgctcccaaccctggtttcaccacaaaatttctagagatgaagctcagcgactgattattcagcaaggacttgtagatggagttttcttggtacgggatagtcagagtaaccccaaaacttttgtactatcaatgagtcatggacaaaaaataaagcactttcaaattataccaattgaagatgatggtgcaatgttccatacactggatgatggccacacaagatttacagatctaattcaactggtggagttctatcaactcaataagggtgttcttccttgcaagttgaagcattattgtgctaggatggctctttaaccaaaccagaagtgacttgtgaaactattgaaggaaaaagaactcaagaagaaaattaagagagagaccataaataagggtgaaaatgttaaccatggggaaaagaatgtatttcatctcaagttacaagaaagagttatacattgcaaataagcaaagacttggattgacattatattcatcatttaaagttcattagttaaaaattaaactttaggaaaaaa

SEQ ID NO: 46 - DNA, 1972 bp, Oryctolagus cuniculus
ttttttcctaaagtttaatttttaactaatgaactttaaatgatgaatataatgtcaatccaagtctttgcttatttgcaatgtataactctttcttgtaacttgagatgaaatacattcttttccccatggttaacattttcacccttatttatggtctctctcttaattttcttcttgagttctttttccttcaatagtttcacaagtcacttctggtttggttaaagagccatcctagcacaataatgcttcaacttgcaaggaagaacacccttattgagttgatagaactccaccagttgaattagatctgtaaatcttgtgtggccatcatccagtgtatggaacattgcaccatcatcttcaattggtataatttgaaagtgctttattttttgtccatgactcattgatagtacaaaagttttggggttactctgactatcccgtaccaagaaaactccatctacaagtccttgctgaataatcagtcgctgagcttcatctctagaaattttgtggtgaaaccagggttgggagcggtggatagccatgtttgcggcactgctctgcgaagaagcagtggggctaccatggacgccaaggcgtaaacatccttttttcctccaagcaagtccttcttcgactgcaactgaaagggcttctgtgggattttcgataactctgcttttctgacctgagaagtccattgctaccagagaattctctgatatactcctcatgggtgatatactctgagaactgcagccacttctaccttgatatggatgcatataattctggtagagctgcatgccatacttaagtaatcgaatggcagtcacccagcacgtcctgctctgctcttcttctgcacagagcattttcaggtctcggggccctcctgctttgttaggcttaaagcagaatccatagtgagtcggtgctccgtgtttttttctgcctgtcagtgacacatatatatcactactgccaaattcgctgaaaaactgcaaatgtcgtggttcctttgatgtccctttagtagaaaaatataaaccagatcttctcagaaggaagtaaatttttttccaggacttctttccctgttcttttgcatgtaagaagccatggatttcaggatatgtagttgaactcagaaacatcattggatttttaaagaattcatatttggcataattttttcgaaagaataacttattttcttcttccattccccagttggatagcacttcggtcactagctcatggtcttctattattctttctacacctatgtgaggcagatgctcaaagagtgtccagctgtggtcatcgacgtaatgattctttagaatcaacaactggcaaacatctcgggctgttatgtcactgggaacctctagagccctgctggtttcatcttcactgtacactttaatcacctgttttttccttgaatttgctttgggaaagaggcctgctgacaacacagatgtaaatggagaacagcagagctcaggaaaggggtttggaatagatggcgtttccagaacatcaagatctttcttttttctcctgtctgcagcacagccgcgggtcccgtccggagccggcaccagagctcgcgcgtgcagccagggggcccgcgccgggtcgtgggcgtcgtcccttccctgggcagcgccgcacacctgggcggccagcggcgagtcccgggcagccgccctgtccgcggcgctctgcccatcttgcagggaagtggtcatggttgccggcccgggggctcaggcggcatgggagcccgggcgcctaggctgcggggtgtcgggaggcgggaggcgggatgccggctcggcggcccgagcgccctgcaggtgcggtggcctggccgcctgcgctccggccccggcggctcagcagctcggctgagcagtctgcgaggcggcgggggaggggagggggcgga

SEQ ID NO: 47 - DNA, 1709 bp, Oryctolagus cuniculus
catttattacttccctggttgtttctttgcactgagccctgagattcccaaggagtaaccgttaaagatttctttcatttcgtctatgacctgcaaggggaaatcattctcagaagagcaggcatgagtttgagtgcaagaagagtgactctgcctgcaataacaccactagttctacagaaaagggtgattaaagtgtacagtgaagatgaaaccagcagggctctagaggttcccagtgacataacagcccgagatgtttgccagttgttgattctaaagaatcattacgtcgatgaccacagctggacactctttgagcatctgcctcacataggtgtagaaagaataatagaagaccatgagctagtgaccgaagtgctatccaactggggaatggaagaagaaaataagttattctttcgaaaaaattatgccaaatatgaattctttaaaaatccaatgtatttttttccagagcatatggtgtcttttgcaactgaaaccaatggtgaaatttcccccacacagattttacagatgtttctgagttcaactacatatcctgaaatccatggcttcttacatgcaaaagaacagggaaagaagtcctggaaaaaaatttacttccttctgagaagatctggtttatatttttctactaaagggacatcaaaggaaccacgacatttgcagtttttcagcgaatttggcagtagtgatatatatgtgtcactgacaggcagaaaaaaacacggagcaccgactcactatggattctgctttaagcctaacaaagcaggagggccccgagacctgaaaatgctctgtgcagaagaagagcagagcaggacgtgctgggtgactgccattcgattacttaagtatggcatgcagctctaccagaattatatgcatccatatcaaggtagaagtggctgcagttctcagagtatatcacccatgaggagtatatcagagaattctctggtagcaatggacttctcaggtcagaaaagcagagttatcgaaaatcccacagaagccctttcagttgcagtcgaagaaggacttgcttggaggaaaaaaggatgtttacgccttggcgtccatggtagccccactgcttcttcgcagagcagtgccgcaaacatggctatccaccgctcccaaccctggtttcaccacaaaatttctagagatgaagctcagcgactgattattcagcaaggacttgtagatggagttttcttggtacgggatagtcagagtaaccccaaaacttttgtactatcaatgagtcatggacaaaaaataaagcactttcaaattataccaattgaagatgatggtgcaatgttccatacactggatgatggccacacaagatttacagatctaattcaactggtggagttctatcaactcaataagggtgttcttccttgcaagttgaagcattattgtgctaggatggctctttaaccaaaccagaagtgacttgtgaaactattgaaggaaaaagaactcaagaagaaaattaagagagagaccataaataagggtgaaaatgttaaccatggggaaaagaatgtatttcatctcaagttacaagaaagagttatacattgcaaataagcaaagacttggattgacattatattcatcatttaaagttcattagttaaaaattaaactttaggaaaaaa

SEQ ID NO: 48 - DNA, 1709 bp, Oryctolagus cuniculus
ttttttcctaaagtttaatttttaactaatgaactttaaatgatgaatataatgtcaatccaagtctttgcttatttgcaatgtataactctttcttgtaacttgagatgaaatacattcttttccccatggttaacattttcacccttatttatggtctctctcttaattttcttcttgagttctttttccttcaatagtttcacaagtcacttctggtttggttaaagagccatcctagcacaataatgcttcaacttgcaaggaagaacacccttattgagttgatagaactccaccagttgaattagatctgtaaatcttgtgtggccatcatccagtgtatggaacattgcaccatcatcttcaattggtataatttgaaagtgctttattttttgtccatgactcattgatagtacaaaagttttggggttactctgactatcccgtaccaagaaaactccatctacaagtccttgctgaataatcagtcgctgagcttcatctctagaaattttgtggtgaaaccagggttgggagcggtggatagccatgtttgcggcactgctctgcgaagaagcagtggggctaccatggacgccaaggcgtaaacatccttttttcctccaagcaagtccttcttcgactgcaactgaaagggcttctgtgggattttcgataactctgcttttctgacctgagaagtccattgctaccagagaattctctgatatactcctcatgggtgatatactctgagaactgcagccacttctaccttgatatggatgcatataattctggtagagctgcatgccatacttaagtaatcgaatggcagtcacccagcacgtcctgctctgctcttcttctgcacagagcattttcaggtctcggggccctcctgctttgttaggcttaaagcagaatccatagtgagtcggtgctccgtgtttttttctgcctgtcagtgacacatatatatcactactgccaaattcgctgaaaaactgcaaatgtcgtggttcctttgatgtccctttagtagaaaaatataaaccagatcttctcagaaggaagtaaatttttttccaggacttctttccctgttcttttgcatgtaagaagccatggatttcaggatatgtagttgaactcagaaacatctgtaaaatctgtgtgggggaaatttcaccattggtttcagttgcaaaagacaccatatgctctggaaaaaaatacattggatttttaaagaattcatatttggcataattttttcgaaagaataacttattttcttcttccattccccagttggatagcacttcggtcactagctcatggtcttctattattctttctacacctatgtgaggcagatgctcaaagagtgtccagctgtggtcatcgacgtaatgattctttagaatcaacaactggcaaacatctcgggctgttatgtcactgggaacctctagagccctgctggtttcatcttcactgtacactttaatcacccttttctgtagaactagtggtgttattgcaggcagagtcactcttcttgcactcaaactcatgcctgctcttctgagaatgatttccccttgcaggtcatagacgaaatgaaagaaatctttaacggttactccttgggaatctcagggctcagtgcaaagaaacaaccagggaagtaataaatg

SEQ ID NO: 49 - protein, 16 aa, Unknown
  Description of Unknown: RFGF peptide sequence
AAVALLPAVLLALLAP

SEQ ID NO: 50 - protein, 11 aa, Unknown
  Description of Unknown: RFGF analogue sequence
AALLPVLLAAP

SEQ ID NO: 51 - protein, 13 aa, Human immunodeficiency virus
GRKKRRQRRRPPQ

SEQ ID NO: 52 - protein, 16 aa, Drosophila sp.
RQIKIWFQNRRMKWKK

SEQ ID NO: 53 - RNA, 21 nt, Artificial Sequence
  Description of Artificial Sequence: Synthetic oligonucleotide
caagguggagcagacaccucu

SEQ ID NO: 54 - RNA, 21 nt, Artificial Sequence
  Description of Artificial Sequence: Synthetic oligonucleotide
gagcagacaccucgcagucau

SEQ ID NO: 55 - RNA, 21 nt, Artificial Sequence
  Description of Artificial Sequence: Synthetic oligonucleotide
caccucgcagucaacaagacu

SEQ ID NO: 56 - RNA, 21 nt, Artificial Sequence
  Description of Artificial Sequence: Synthetic oligonucleotide
cagucaacaagacccggcagu

SEQ ID NO: 57 - RNA, 21 nt, Artificial Sequence
  Description of Artificial Sequence: Synthetic oligonucleotide
caagacccggcaggaccaggu

SEQ ID NO: 58 - RNA, 21 nt, Artificial Sequence
  Description of Artificial Sequence: Synthetic oligonucleotide
cgcacagucugaccgacuugu

SEQ ID NO: 59 - RNA, 21 nt, Artificial Sequence
  Description of Artificial Sequence: Synthetic oligonucleotide
ucugaccgacuugcgaaucau

SEQ ID NO: 60 - RNA, 21 nt, Artificial Sequence
  Description of Artificial Sequence: Synthetic oligonucleotide
gaugauguggaccuggaagcu

SEQ ID NO: 61 - RNA, 21 nt, Artificial Sequence
  Description of Artificial Sequence: Synthetic oligonucleotide
uggaccuggaagcccuggugu

SEQ ID NO: 62 - RNA, 21 nt, Artificial Sequence
  Description of Artificial Sequence: Synthetic oligonucleotide
ggaagcccuggugaacgauau

SEQ ID NO: 63 - RNA, 21 nt, Artificial Sequence
  Description of Artificial Sequence: Synthetic oligonucleotide
cuggugaacgauaugaaugcu

SEQ ID NO: 64 - RNA, 21 nt, Artificial Sequence
  Description of Artificial Sequence: Synthetic oligonucleotide
acgauaugaaugcaucccugu

SEQ ID NO: 65 - RNA, 21 nt, Artificial Sequence
  Description of Artificial Sequence: Synthetic oligonucleotide
gaaugcaucccuggagagccu

SEQ ID NO: 66 - RNA, 21 nt, Artificial Sequence
  Description of Artificial Sequence: Synthetic oligonucleotide
ucccuggagagccuguacucu

SEQ ID NO: 67 - RNA, 21 nt, Artificial Sequence
  Description of Artificial Sequence: Synthetic oligonucleotide
gagccuguacucggccugcau

SEQ ID NO: 68 - RNA, 21 nt, Artificial Sequence
  Description of Artificial Sequence: Synthetic oligonucleotide
uacucggccugcagcaugcau

SEQ ID NO: 69 - RNA, 21 nt, Artificial Sequence
  Description of Artificial Sequence: Synthetic oligonucleotide
ccugcagcaugcagucagacu

SEQ ID NO: 70 - RNA, 21 nt, Artificial Sequence
  Description of Artificial Sequence: Synthetic oligonucleotide
caugcagucagacacggugcu

SEQ ID NO: 71 - RNA, 21 nt, Artificial Sequence
  Description of Artificial Sequence: Synthetic oligonucleotide
cuccugcagaauggccagcau

SEQ ID NO: 72 - RNA, 21 nt, Artificial Sequence
  Description of Artificial Sequence: Synthetic oligonucleotide
gaauggccagcaugcccgcau

SEQ ID NO: 73 - RNA, 21 nt, Artificial Sequence
  Description of Artificial Sequence: Synthetic oligonucleotide
ucaggcccuccucgguccauu

SEQ ID NO: 74 - RNA, 21 nt, Artificial Sequence
  Description of Artificial Sequence: Synthetic oligonucleotide
ccucgguccauccagccacau

SEQ ID NO: 75 - RNA, 21 nt, Artificial Sequence
  Description of Artificial Sequence: Synthetic oligonucleotide
ccauccagccacagguguccu

SEQ ID NO: 76 - RNA, 21 nt, Artificial Sequence
  Description of Artificial Sequence: Synthetic oligonucleotide
cgcucccagccugugcacauu

SEQ ID NO: 77 - RNA, 21 nt, Artificial Sequence
  Description of Artificial Sequence: Synthetic oligonucleotide
agccugugcacauccucgcuu

SEQ ID NO: 78 - RNA, 21 nt, Artificial Sequence
  Description of Artificial Sequence: Synthetic oligonucleotide
gccuucaggaggaagaccagu

SEQ ID NO: 79 - RNA, 21 nt, Artificial Sequence
  Description of Artificial Sequence: Synthetic oligonucleotide
ggaggaagaccagcaguuuau

SEQ ID NO: 80 - RNA, 21 nt, Artificial Sequence
  Description of Artificial Sequence: Synthetic oligonucleotide
gaccagcaguuuagaaccucu

SEQ ID NO: 81 - RNA, 21 nt, Artificial Sequence
  Description of Artificial Sequence: Synthetic oligonucleotide
aguuuagaaccucaucucugu

SEQ ID NO: 82 - RNA, 21 nt, Artificial Sequence
  Description of Artificial Sequence: Synthetic oligonucleotide
aaccucaucucugccggccau

SEQ ID NO: 83 - RNA, 21 nt, Artificial Sequence
  Description of Artificial Sequence: Synthetic oligonucleotide
caauccuuuuccugaacucuu

SEQ ID NO: 84 - RNA, 21 nt, Artificial Sequence
  Description of Artificial Sequence: Synthetic oligonucleotide
uuuccugaacucuguggcccu

SEQ ID NO: 85 - RNA, 21 nt, Artificial Sequence
  Description of Artificial Sequence: Synthetic oligonucleotide
aacucuguggcccugggagcu

SEQ ID NO: 86 - RNA, 21 nt, Artificial Sequence
  Description of Artificial Sequence: Synthetic oligonucleotide
ugugcucacgccggguucuuu

SEQ ID NO: 87 - RNA, 21 nt, Artificial Sequence
  Description of Artificial Sequence: Synthetic oligonucleotide
acgccggguucuuuaccuccu

SEQ ID NO: 88 - RNA, 21 nt, Artificial Sequence
  Description of Artificial Sequence: Synthetic oligonucleotide
guucuuuaccuccgagccagu

SEQ ID NO: 89 - RNA, 21 nt, Artificial Sequence
  Description of Artificial Sequence: Synthetic oligonucleotide
uguuaaagucuuuagugaagu

SEQ ID NO: 90 - RNA, 21 nt, Artificial Sequence
  Description of Artificial Sequence: Synthetic oligonucleotide
gucuuuagugaagaugggacu

SEQ ID NO: 91 - RNA, 21 nt, Artificial Sequence
  Description of Artificial Sequence: Synthetic oligonucleotide
gugaagaugggacaagcaaau

SEQ ID NO: 92 - RNA, 21 nt, Artificial Sequence
  Description of Artificial Sequence: Synthetic oligonucleotide
ugggacaagcaaagugguggu

SEQ ID NO: 93 - RNA, 21 nt, Artificial Sequence
  Description of Artificial Sequence: Synthetic oligonucleotide
agcaaagugguggagauucuu

SEQ ID NO: 94 - RNA, 21 nt, Artificial Sequence
  Description of Artificial Sequence: Synthetic oligonucleotide
ugguggagauucuagcagacu

SEQ ID NO: 95 - RNA, 21 nt, Artificial Sequence
  Description of Artificial Sequence: Synthetic oligonucleotide
gauucuagcagacaugacagu

SEQ ID NO: 96 - RNA, 21 nt, Artificial Sequence
  Description of Artificial Sequence: Synthetic oligonucleotide
gcagacaugacagccagagau

SEQ ID NO: 97 - RNA, 21 nt, Artificial Sequence
  Description of Artificial Sequence: Synthetic oligonucleotide
ugacagccagagaccugugcu

SEQ ID NO: 98 - RNA, 21 nt, Artificial Sequence
  Description of Artificial Sequence: Synthetic oligonucleotide
cagagaccugugccaauugcu

SEQ ID NO: 99 - RNA, 21 nt, Artificial Sequence
  Description of Artificial Sequence: Synthetic oligonucleotide
cugugccaauugcugguuuau

SEQ ID NO: 100 - RNA, 21 nt, Artificial Sequence
  Description of Artificial Sequence: Synthetic oligonucleotide
aauugcugguuuacaaaaguu

SEQ ID NO: 101 - RNA, 21 nt, Artificial Sequence
  Description of Artificial Sequence: Synthetic oligonucleotide
gguuuacaaaagucacugugu

SEQ ID NO: 102 - RNA, 21 nt, Artificial Sequence
  Description of Artificial Sequence: Synthetic oligonucleotide
aaaagucacuguguggaugau

SEQ ID NO: 103 - RNA, 21 nt, Artificial Sequence
  Description of Artificial Sequence: Synthetic oligonucleotide
acuguguggaugacaacagcu

SEQ ID NO: 104 - RNA, 21 nt, Artificial Sequence
  Description of Artificial Sequence: Synthetic oligonucleotide
ggaugacaacagcuggacacu

SEQ ID NO: 105 - RNA, 21 nt, Artificial Sequence
  Description of Artificial Sequence: Synthetic oligonucleotide
aacagcuggacacuaguggau

SEQ ID NO: 106 - RNA, 21 nt, Artificial Sequence
  Description of Artificial Sequence: Synthetic oligonucleotide
ggacacuaguggagcaccacu

SEQ ID NO: 107 - RNA, 21 nt, Artificial Sequence
  Description of Artificial Sequence: Synthetic oligonucleotide
guggagcaccacccgcaccuu

SEQ ID NO: 108 - RNA, 21 nt, Artificial Sequence
  Description of Artificial Sequence: Synthetic oligonucleotide
accacccgcaccuaggauuau

SEQ ID NO: 109 - RNA, 21 nt, Artificial Sequence
  Description of Artificial Sequence: Synthetic oligonucleotide
aggugcuuggaagaccaugau

SEQ ID NO: 110 - RNA, 21 nt, Artificial Sequence
  Description of Artificial Sequence: Synthetic oligonucleotide
uggaagaccaugagcuggugu

SEQ ID NO: 111 - RNA, 21 nt, Artificial Sequence
  Description of Artificial Sequence: Synthetic oligonucleotide
ccaugagcuggugguccaggu

SEQ ID NO: 112 - RNA, 21 nt, Artificial Sequence
  Description of Artificial Sequence: Synthetic oligonucleotide
cuggugguccagguggagagu

SEQ ID NO: 113 - RNA, 21 nt, Artificial Sequence
  Description of Artificial Sequence: Synthetic oligonucleotide
uccagguggagaguaccaugu

SEQ ID NO: 114 - RNA, 21 nt, Artificial Sequence
  Description of Artificial Sequence: Synthetic oligonucleotide
ggagaguaccauggccagugu

SEQ ID NO: 115 - RNA, 21 nt, Artificial Sequence
  Description of Artificial Sequence: Synthetic oligonucleotide
accauggccagugagaguaau

SEQ ID NO: 116 - RNA, 21 nt, Artificial Sequence
  Description of Artificial Sequence: Synthetic oligonucleotide
ccagugagaguaaauuucuau

SEQ ID NO: 117 - RNA, 21 nt, Artificial Sequence
  Description of Artificial Sequence: Synthetic oligonucleotide
gaguaaauuucuauucaggau

SEQ ID NO: 118 - RNA, 21 nt, Artificial Sequence
  Description of Artificial Sequence: Synthetic oligonucleotide
uucuauucaggaagaauuacu

SEQ ID NO: 119 - RNA, 21 nt, Artificial Sequence
  Description of Artificial Sequence: Synthetic oligonucleotide
caggaagaauuacgcaaaauu

SEQ ID NO: 120 - RNA, 21 nt, Artificial Sequence
  Description of Artificial Sequence: Synthetic oligonucleotide
aauuacgcaaaauacgaguuu

SEQ ID NO: 121 - RNA, 21 nt, Artificial Sequence
  Description of Artificial Sequence: Synthetic oligonucleotide
caaaauacgaguucuuuaaau

SEQ ID NO: 122 - RNA, 21 nt, Artificial Sequence
  Description of Artificial Sequence: Synthetic oligonucleotide
uuucuucccagaacagauggu

SEQ ID NO: 123 - RNA, 21 nt, Artificial Sequence
  Description of Artificial Sequence: Synthetic oligonucleotide
ccagaacagaugguuacuugu

SEQ ID NO: 124 - RNA, 21 nt, Artificial Sequence
  Description of Artificial Sequence: Synthetic oligonucleotide
agaugguuacuuggugccagu

SEQ ID NO: 125 - RNA, 21 nt, Artificial Sequence
  Description of Artificial Sequence: Synthetic oligonucleotide
uacuuggugccagcagucaau

SEQ ID NO: 126 - RNA, 21 nt, Artificial Sequence
  Description of Artificial Sequence: Synthetic oligonucleotide
ugccagcagucaaauggcagu

SEQ ID NO: 127 - RNA, 21 nt, Artificial Sequence
  Description of Artificial Sequence: Synthetic oligonucleotide
agucaaauggcagucaaaccu

SEQ ID NO: 128 - RNA, 21 nt, Artificial Sequence
  Description of Artificial Sequence: Synthetic oligonucleotide
uggcagucaaacccagcuuuu

SEQ ID NO: 129 - RNA, 21 nt, Artificial Sequence
  Description of Artificial Sequence: Synthetic oligonucleotide
uuuucugaacuccaguaguuu

SEQ ID NO: 130 - RNA, 21 nt, Artificial Sequence
  Description of Artificial Sequence: Synthetic oligonucleotide
aacuccaguaguuguccugau

SEQ ID NO: 131 - RNA, 21 nt, Artificial Sequence
  Description of Artificial Sequence: Synthetic oligonucleotide
guaguuguccugaaauucaau

SEQ ID NO: 132 - RNA, 21 nt, Artificial Sequence
  Description of Artificial Sequence: Synthetic oligonucleotide
uugcaugugaaagagcugggu

SEQ ID NO: 133 - RNA, 21 nt, Artificial Sequence
  Description of Artificial Sequence: Synthetic oligonucleotide
ugaaagagcugggaaagaaau

SEQ ID NO: 134 - RNA, 21 nt, Artificial Sequence
  Description of Artificial Sequence: Synthetic oligonucleotide
gcugggaaagaaaucauggau

SEQ ID NO: 135 - RNA, 21 nt, Artificial Sequence
  Description of Artificial Sequence: Synthetic oligonucleotide
aagcuguauguguguuugcgu

SEQ ID NO: 136 - RNA, 21 nt, Artificial Sequence
  Description of Artificial Sequence: Synthetic oligonucleotide
auguguguuugcggagaucuu

SEQ ID NO: 137 - RNA, 21 nt, Artificial Sequence
  Description of Artificial Sequence: Synthetic oligonucleotide
uuugcggagaucuggccuuuu

SEQ ID NO: 138 - RNA, 21 nt, Artificial Sequence
  Description of Artificial Sequence: Synthetic oligonucleotide
agaucuggccuuuauugcucu

SEQ ID NO: 139 - RNA, 21 nt, Artificial Sequence
  Description of Artificial Sequence: Synthetic oligonucleotide
gccuuuauugcuccaccaagu

SEQ ID NO: 140 - RNA, 21 nt, Artificial Sequence
  Description of Artificial Sequence: Synthetic oligonucleotide
uugcuccaccaagggaacuuu

SEQ ID NO: 141 - RNA, 21 nt, Artificial Sequence
  Description of Artificial Sequence: Synthetic oligonucleotide
acccagacaccugcagcugcu

SEQ ID NO: 142 - RNA, 21 nt, Artificial Sequence
  Description of Artificial Sequence: Synthetic oligonucleotide
gccgaccuggaggacagcaau

SEQ ID NO: 143 - RNA, 21 nt, Artificial Sequence
  Description of Artificial Sequence: Synthetic oligonucleotide
uggaggacagcaacaucuucu

SEQ ID NO: 144 - RNA, 21 nt, Artificial Sequence
  Description of Artificial Sequence: Synthetic oligonucleotide
cagcaacaucuucucccugau

SEQ ID NO: 145 - RNA, 21 nt, Artificial Sequence
  Description of Artificial Sequence: Synthetic oligonucleotide
aucuucucccugaucgcuggu

SEQ ID NO: 146 - RNA, 21 nt, Artificial Sequence
  Description of Artificial Sequence: Synthetic oligonucleotide
cccugaucgcuggcaggaagu

SEQ ID NO: 147 - RNA, 21 nt, Artificial Sequence
  Description of Artificial Sequence: Synthetic oligonucleotide
cgcuggcaggaagcaguacau

SEQ ID NO: 148 - RNA, 21 nt, Artificial Sequence
  Description of Artificial Sequence: Synthetic oligonucleotide
uacagaccacgggcucugcau

SEQ ID NO: 149 - RNA, 21 nt, Artificial Sequence
  Description of Artificial Sequence: Synthetic oligonucleotide
aaacaaagucaggaaugaaau

SEQ ID NO: 150 - RNA, 21 nt, Artificial Sequence
  Description of Artificial Sequence: Synthetic oligonucleotide
gucaggaaugaaacuaaagau

SEQ ID NO: 151 - RNA, 21 nt, Artificial Sequence
  Description of Artificial Sequence: Synthetic oligonucleotide
augaaacuaaagagcugaggu

SEQ ID NO: 152 - RNA, 21 nt, Artificial Sequence
  Description of Artificial Sequence: Synthetic oligonucleotide
uaaagagcugagguugcucuu

SEQ ID NO: 153 - RNA, 21 nt, Artificial Sequence
  Description of Artificial Sequence: Synthetic oligonucleotide
cugagguugcucugugcagau

SEQ ID NO: 154 - RNA, 21 nt, Artificial Sequence
  Description of Artificial Sequence: Synthetic oligonucleotide
ugcucugugcagaggacgagu

SEQ ID NO: 155 - RNA, 21 nt, Artificial Sequence
  Description of Artificial Sequence: Synthetic oligonucleotide
ugcagaggacgagcaaaccau

SEQ ID NO: 156 - RNA, 21 nt, Artificial Sequence
  Description of Artificial Sequence: Synthetic oligonucleotide
gacgagcaaaccaggacgugu

SEQ ID NO: 157 - RNA, 21 nt, Artificial Sequence
  Description of Artificial Sequence: Synthetic oligonucleotide
aaaccaggacgugcuggaugu

SEQ ID NO: 158 - RNA, 21 nt, Artificial Sequence
  Description of Artificial Sequence: Synthetic oligonucleotide
gacgugcuggaugacagcguu

SEQ ID NO: 159 - RNA, 21 nt, Artificial Sequence
  Description of Artificial Sequence: Synthetic oligonucleotide
uggaugacagcguucagacuu

SEQ ID NO: 160 - RNA, 21 nt, Artificial Sequence
  Description of Artificial Sequence: Synthetic oligonucleotide
uggaaugcuccuuuaccagau

SEQ ID NO: 161 - RNA, 21 nt, Artificial Sequence
  Description of Artificial Sequence: Synthetic oligonucleotide
cuccuuuaccagaauuaccgu

SEQ ID NO: 162 - RNA, 21 nt, Artificial Sequence
  Description of Artificial Sequence: Synthetic oligonucleotide
accagaauuaccgaaucccuu

SEQ ID NO: 163 - RNA, 21 nt, Artificial Sequence
  Description of Artificial Sequence: Synthetic oligonucleotide
uuaccgaaucccucagcagau

SEQ ID NO: 164 - RNA, 21 nt, Artificial Sequence
  Description of Artificial Sequence: Synthetic oligonucleotide
aucccucagcagaggaaggcu

SEQ ID NO: 165 - RNA, 21 nt, Artificial Sequence
  Description of Artificial Sequence: Synthetic oligonucleotide
agcagaggaaggccuugcugu

SEQ ID NO: 166 - RNA, 21 nt, Artificial Sequence
  Description of Artificial Sequence: Synthetic oligonucleotide
cagugucuccgagaacucccu

SEQ ID NO: 167 - RNA, 21 nt, Artificial Sequence
  Description of Artificial Sequence: Synthetic oligonucleotide
uccgagaacucccucguggcu

SEQ ID NO: 168 - RNA, 21 nt, Artificial Sequence
  Description of Artificial Sequence: Synthetic oligonucleotide
acucccucguggcaauggauu

SEQ ID NO: 169 - RNA, 21 nt, Artificial Sequence
  Description of Artificial Sequence: Synthetic oligonucleotide
uucugggcaaacaggacgcgu

SEQ ID NO: 170 - RNA, 21 nt, Artificial Sequence
  Description of Artificial Sequence: Synthetic oligonucleotide
caaacaggacgcgugauagau

SEQ ID NO: 171 - RNA, 21 nt, Artificial Sequence
  Description of Artificial Sequence: Synthetic oligonucleotide
gacgcgugauagagaauccgu

SEQ ID NO: 172 - RNA, 21 nt, Artificial Sequence
  Description of Artificial Sequence: Synthetic oligonucleotide
gauagagaauccggcagaggu

SEQ ID NO: 173 - RNA, 21 nt, Artificial Sequence
  Description of Artificial Sequence: Synthetic oligonucleotide
aauccggcagaggcccagagu

SEQ ID NO: 174 - RNA, 21 nt, Artificial Sequence
  Description of Artificial Sequence: Synthetic oligonucleotide
gcgaagcacacggaugaacau

SEQ ID NO: 175 - RNA, 21 nt, Artificial Sequence
  Description of Artificial Sequence: Synthetic oligonucleotide
acacggaugaacauccuaggu

SEQ ID NO: 176 - RNA, 21 nt, Artificial Sequence
  Description of Artificial Sequence: Synthetic oligonucleotide
ugaacauccuagguagccaau

SEQ ID NO: 177 - RNA, 21 nt, Artificial Sequence
  Description of Artificial Sequence: Synthetic oligonucleotide
cuccacccuucuacccuaagu

SEQ ID NO: 178 - RNA, 21 nt, Artificial Sequence
  Description of Artificial Sequence: Synthetic oligonucleotide
auucacaggacacagcacugu

SEQ ID NO: 179 - RNA, 21 nt, Artificial Sequence
  Description of Artificial Sequence: Synthetic oligonucleotide
ggacacagcacugguuucacu

SEQ ID NO: 180 - RNA, 21 nt, Artificial Sequence
  Description of Artificial Sequence: Synthetic oligonucleotide
gcacugguuucacgggaggau

SEQ ID NO: 181 - RNA, 21 nt, Artificial Sequence
  Description of Artificial Sequence: Synthetic oligonucleotide
uuucacgggaggaucuccagu

SEQ ID NO: 182 - RNA, 21 nt, Artificial Sequence
  Description of Artificial Sequence: Synthetic oligonucleotide
ggaggaucuccagggaggaau

SEQ ID NO: 183 - RNA, 21 nt, Artificial Sequence
  Description of Artificial Sequence: Synthetic oligonucleotide
cuccagggaggaaucccacau

SEQ ID NO: 184 - RNA, 21 nt, Artificial Sequence
  Description of Artificial Sequence: Synthetic oligonucleotide
gaggaaucccacaggaucauu

SEQ ID NO: 185 - RNA, 21 nt, Artificial Sequence
  Description of Artificial Sequence: Synthetic oligonucleotide
cccacaggaucauuaaacagu

SEQ ID NO: 186 - RNA, 21 nt, Artificial Sequence
  Description of Artificial Sequence: Synthetic oligonucleotide
gaucauuaaacagcaagggcu

SEQ ID NO: 187 - RNA, 21 nt, Artificial Sequence
  Description of Artificial Sequence: Synthetic oligonucleotide
aaacagcaagggcucguggau

SEQ ID NO: 188 - RNA, 23 nt, Artificial Sequence
  Description of Artificial Sequence: Synthetic oligonucleotide
agaggugucugcuccaccuuguc

SEQ ID NO: 189 - RNA, 23 nt, Artificial Sequence
  Description of Artificial Sequence: Synthetic oligonucleotide
augacugcgaggugucugcucca

SEQ ID NO: 190 - RNA, 23 nt, Artificial Sequence
  Description of Artificial Sequence: Synthetic oligonucleotide
agucuuguugacugcgagguguc

SEQ ID NO: 191 - RNA, 23 nt, Artificial Sequence
  Description of Artificial Sequence: Synthetic oligonucleotide
acugccgggucuuguugacugcg

SEQ ID NO: 192 - RNA, 23 nt, Artificial Sequence
  Description of Artificial Sequence: Synthetic oligonucleotide
accugguccugccgggucuuguu

SEQ ID NO: 193 - RNA, 23 nt, Artificial Sequence
  Description of Artificial Sequence: Synthetic oligonucleotide
acaagucggucagacugugcggg

SEQ ID NO: 194 - RNA, 23 nt, Artificial Sequence
  Description of Artificial Sequence: Synthetic oligonucleotide
augauucgcaagucggucagacu

SEQ ID NO: 195 - RNA, 23 nt, Artificial Sequence
  Description of Artificial Sequence: Synthetic oligonucleotide
agcuuccagguccacaucauccu

SEQ ID NO: 196 - RNA, 23 nt, Artificial Sequence
  Description of Artificial Sequence: Synthetic oligonucleotide
acaccagggcuuccagguccaca

SEQ ID NO: 197 - RNA, 23 nt, Artificial Sequence
  Description of Artificial Sequence: Synthetic oligonucleotide
auaucguucaccagggcuuccag

SEQ ID NO: 198 - RNA, 23 nt, Artificial Sequence
  Description of Artificial Sequence: Synthetic oligonucleotide
agcauucauaucguucaccaggg

SEQ ID NO: 199 - RNA, 23 nt, Artificial Sequence
  Description of Artificial Sequence: Synthetic oligonucleotide
acagggaugcauucauaucguuc

SEQ ID NO: 200 - RNA, 23 nt, Artificial Sequence
  Description of Artificial Sequence: Synthetic oligonucleotide
aggcucuccagggaugcauucau

SEQ ID NO: 201 - RNA, 23 nt, Artificial Sequence
  Description of Artificial Sequence: Synthetic oligonucleotide
agaguacaggcucuccagggaug

SEQ ID NO: 202 - RNA, 23 nt, Artificial Sequence
  Description of Artificial Sequence: Synthetic oligonucleotide
augcaggccgaguacaggcucuc

SEQ ID NO: 203 - RNA, 23 nt, Artificial Sequence
  Description of Artificial Sequence: Synthetic oligonucleotide
augcaugcugcaggccgaguaca

SEQ ID NO: 204 - RNA, 23 nt, Artificial Sequence
  Description of Artificial Sequence: Synthetic oligonucleotide
agucugacugcaugcugcaggcc

SEQ ID NO: 205 - RNA, 23 nt, Artificial Sequence
  Description of Artificial Sequence: Synthetic oligonucleotide
agcaccgugucugacugcaugcu

SEQ ID NO: 206 - RNA, 23 nt, Artificial Sequence
  Description of Artificial Sequence: Synthetic oligonucleotide
augcuggccauucugcaggaggg

SEQ ID NO: 207 - RNA, 23 nt, Artificial Sequence
  Description of Artificial Sequence: Synthetic oligonucleotide
augcgggcaugcuggccauucug

SEQ ID NO: 208 - RNA, 23 nt, Artificial Sequence
  Description of Artificial Sequence: Synthetic oligonucleotide
aauggaccgaggagggccugaag

SEQ ID NO: 209 - RNA, 23 nt, Artificial Sequence
  Description of Artificial Sequence: Synthetic oligonucleotide
auguggcuggauggaccgaggag

SEQ ID NO: 210 - RNA, 23 nt, Artificial Sequence
  Description of Artificial Sequence: Synthetic oligonucleotide
aggacaccuguggcuggauggac

SEQ ID NO: 211 - RNA, 23 nt, Artificial Sequence
  Description of Artificial Sequence: Synthetic oligonucleotide
aaugugcacaggcugggagcgcu

SEQ ID NO: 212 - RNA, 23 nt, Artificial Sequence
  Description of Artificial Sequence: Synthetic oligonucleotide
aagcgaggaugugcacaggcugg

SEQ ID NO: 213 - RNA, 23 nt, Artificial Sequence
  Description of Artificial Sequence: Synthetic oligonucleotide
acuggucuuccuccugaaggcgc

SEQ ID NO: 214 - RNA, 23 nt, Artificial Sequence
  Description of Artificial Sequence: Synthetic oligonucleotide
auaaacugcuggucuuccuccug

SEQ ID NO: 215 - RNA, 23 nt, Artificial Sequence
  Description of Artificial Sequence: Synthetic oligonucleotide
agagguucuaaacugcuggucuu

SEQ ID NO: 216 - RNA, 23 nt, Artificial Sequence
  Description of Artificial Sequence: Synthetic oligonucleotide
acagagaugagguucuaaacugc

SEQ ID NO: 217 - RNA, 23 nt, Artificial Sequence
  Description of Artificial Sequence: Synthetic oligonucleotide
auggccggcagagaugagguucu

SEQ ID NO: 218 - RNA, 23 nt, Artificial Sequence
  Description of Artificial Sequence: Synthetic oligonucleotide
aagaguucaggaaaaggauuggg

SEQ ID NO: 219 - RNA, 23 nt, Artificial Sequence
  Description of Artificial Sequence: Synthetic oligonucleotide
agggccacagaguucaggaaaag

SEQ ID NO: 220 - RNA, 23 nt, Artificial Sequence
  Description of Artificial Sequence: Synthetic oligonucleotide
agcucccagggccacagaguuca

SEQ ID NO: 221 - RNA, 23 nt, Artificial Sequence
  Description of Artificial Sequence: Synthetic oligonucleotide
aaagaacccggcgugagcacagg

SEQ ID NO: 222 - RNA, 23 nt, Artificial Sequence
  Description of Artificial Sequence: Synthetic oligonucleotide
aggagguaaagaacccggcguga

SEQ ID NO: 223 - RNA, 23 nt, Artificial Sequence
  Description of Artificial Sequence: Synthetic oligonucleotide
acuggcucggagguaaagaaccc

SEQ ID NO: 224 - RNA, 23 nt, Artificial Sequence
  Description of Artificial Sequence: Synthetic oligonucleotide
acuucacuaaagacuuuaacauc

SEQ ID NO: 225 - RNA, 23 nt, Artificial Sequence
  Description of Artificial Sequence: Synthetic oligonucleotide
agucccaucuucacuaaagacuu

SEQ ID NO: 226 - RNA, 23 nt, Artificial Sequence
  Description of Artificial Sequence: Synthetic oligonucleotide
auuugcuugucccaucuucacua

SEQ ID NO: 227 - RNA, 23 nt, Artificial Sequence
  Description of Artificial Sequence: Synthetic oligonucleotide
accaccacuuugcuugucccauc

SEQ ID NO: 228 - RNA, 23 nt, Artificial Sequence
  Description of Artificial Sequence: Synthetic oligonucleotide
aagaaucuccaccacuuugcuug

SEQ ID NO: 229 - RNA, 23 nt, Artificial Sequence
  Description of Artificial Sequence: Synthetic oligonucleotide
agucugcuagaaucuccaccacu

SEQ ID NO: 230 - RNA, 23 nt, Artificial Sequence
  Description of Artificial Sequence: Synthetic oligonucleotide
acugucaugucugcuagaaucuc

SEQ ID NO: 231 - RNA, 23 nt, Artificial Sequence
  Description of Artificial Sequence: Synthetic oligonucleotide
aucucuggcugucaugucugcua

SEQ ID NO: 232 - RNA, 23 nt, Artificial Sequence
  Description of Artificial Sequence: Synthetic oligonucleotide
agcacaggucucuggcugucaug

SEQ ID NO: 233 - RNA, 23 nt, Artificial Sequence
  Description of Artificial Sequence: Synthetic oligonucleotide
agcaauuggcacaggucucuggc

SEQ ID NO: 234 - RNA, 23 nt, Artificial Sequence
  Description of Artificial Sequence: Synthetic oligonucleotide
auaaaccagcaauuggcacaggu

SEQ ID NO: 235 - RNA, 23 nt, Artificial Sequence
  Description of Artificial Sequence: Synthetic oligonucleotide
aacuuuuguaaaccagcaauugg

SEQ ID NO: 236 - RNA, 23 nt, Artificial Sequence
  Description of Artificial Sequence: Synthetic oligonucleotide
acacagugacuuuuguaaaccag

SEQ ID NO: 237 - RNA, 23 nt, Artificial Sequence
  Description of Artificial Sequence: Synthetic oligonucleotide
aucauccacacagugacuuuugu

SEQ ID NO: 238 - RNA, 23 nt, Artificial Sequence
  Description of Artificial Sequence: Synthetic oligonucleotide
agcuguugucauccacacaguga

SEQ ID NO: 239 - RNA, 23 nt, Artificial Sequence
  Description of Artificial Sequence: Synthetic oligonucleotide
aguguccagcuguugucauccac

SEQ ID NO: 240 - RNA, 23 nt, Artificial Sequence
  Description of Artificial Sequence: Synthetic oligonucleotide
auccacuaguguccagcuguugu

SEQ ID NO: 241 - RNA, 23 nt, Artificial Sequence
  Description of Artificial Sequence: Synthetic oligonucleotide
aguggugcuccacuaguguccag

SEQ ID NO: 242 - RNA, 23 nt, Artificial Sequence
  Description of Artificial Sequence: Synthetic oligonucleotide
aaggugcggguggugcuccacua

SEQ ID NO: 243 - RNA, 23 nt, Artificial Sequence
  Description of Artificial Sequence: Synthetic oligonucleotide
auaauccuaggugcggguggugc

SEQ ID NO: 244 - RNA, 23 nt, Artificial Sequence
  Description of Artificial Sequence: Synthetic oligonucleotide
aucauggucuuccaagcaccucu

SEQ ID NO: 245 - RNA, 23 nt, Artificial Sequence
  Description of Artificial Sequence: Synthetic oligonucleotide
acaccagcucauggucuuccaag

SEQ ID NO: 246 - RNA, 23 nt, Artificial Sequence
  Description of Artificial Sequence: Synthetic oligonucleotide
accuggaccaccagcucaugguc

SEQ ID NO: 247 - RNA, 23 nt, Artificial Sequence
  Description of Artificial Sequence: Synthetic oligonucleotide
acucuccaccuggaccaccagcu

SEQ ID NO: 248 - RNA, 23 nt, Artificial Sequence
  Description of Artificial Sequence: Synthetic oligonucleotide
acaugguacucuccaccuggacc

SEQ ID NO: 249 - RNA, 23 nt, Artificial Sequence
  Description of Artificial Sequence: Synthetic oligonucleotide
acacuggccaugguacucuccac

SEQ ID NO: 250 - RNA, 23 nt, Artificial Sequence
  Description of Artificial Sequence: Synthetic oligonucleotide
auuacucucacuggccaugguac

SEQ ID NO: 251 - RNA, 23 nt, Artificial Sequence
  Description of Artificial Sequence: Synthetic oligonucleotide
auagaaauuuacucucacuggcc

SEQ ID NO: 252 - RNA, 23 nt, Artificial Sequence
  Description of Artificial Sequence: Synthetic oligonucleotide
auccugaauagaaauuuacucuc

SEQ ID NO: 253 - RNA, 23 nt, Artificial Sequence
  Description of Artificial Sequence: Synthetic oligonucleotide
aguaauucuuccugaauagaaau

SEQ ID NO: 254 - RNA, 23 nt, Artificial Sequence
  Description of Artificial Sequence: Synthetic oligonucleotide
aauuuugcguaauucuuccugaa

SEQ ID NO: 255 - RNA, 23 nt, Artificial Sequence
  Description of Artificial Sequence: Synthetic oligonucleotide
aaacucguauuuugcguaauucu

SEQ ID NO: 256 - RNA, 23 nt, Artificial Sequence
  Description of Artificial Sequence: Synthetic oligonucleotide
auuuaaagaacucguauuuugcg

SEQ ID NO: 257 - RNA, 23 nt, Artificial Sequence
  Description of Artificial Sequence: Synthetic oligonucleotide
accaucuguucugggaagaaauu

SEQ ID NO: 258 - RNA, 23 nt, Artificial Sequence
  Description of Artificial Sequence: Synthetic oligonucleotide
acaaguaaccaucuguucuggga

SEQ ID NO: 259 - RNA, 23 nt, Artificial Sequence
  Description of Artificial Sequence: Synthetic oligonucleotide
acuggcaccaaguaaccaucugu

SEQ ID NO: 260 - RNA, 23 nt, Artificial Sequence
  Description of Artificial Sequence: Synthetic oligonucleotide
auugacugcuggcaccaaguaac

SEQ ID NO: 261 - RNA, 23 nt, Artificial Sequence
  Description of Artificial Sequence: Synthetic oligonucleotide
acugccauuugacugcuggcacc

SEQ ID NO: 262 - RNA, 23 nt, Artificial Sequence
  Description of Artificial Sequence: Synthetic oligonucleotide
agguuugacugccauuugacugc

SEQ ID NO: 263 - RNA, 23 nt, Artificial Sequence
  Description of Artificial Sequence: Synthetic oligonucleotide
aaaagcuggguuugacugccauu

SEQ ID NO: 264 - RNA, 23 nt, Artificial Sequence
  Description of Artificial Sequence: Synthetic oligonucleotide
aaacuacuggaguucagaaaauu

SEQ ID NO: 265 - RNA, 23 nt, Artificial Sequence
  Description of Artificial Sequence: Synthetic oligonucleotide
aucaggacaacuacuggaguuca

SEQ ID NO: 266 - RNA, 23 nt, Artificial Sequence
  Description of Artificial Sequence: Synthetic oligonucleotide
auugaauuucaggacaacuacug

SEQ ID NO: 267 - RNA, 23 nt, Artificial Sequence
  Description of Artificial Sequence: Synthetic oligonucleotide
acccagcucuuucacaugcaaaa

SEQ ID NO: 268 - RNA, 23 nt, Artificial Sequence
  Description of Artificial Sequence: Synthetic oligonucleotide
auuucuuucccagcucuuucaca

SEQ ID NO: 269 - RNA, 23 nt, Artificial Sequence
  Description of Artificial Sequence: Synthetic oligonucleotide
auccaugauuucuuucccagcuc

SEQ ID NO: 270 - RNA, 23 nt, Artificial Sequence
  Description of Artificial Sequence: Synthetic oligonucleotide
acgcaaacacacauacagcuuuu

SEQ ID NO: 271 - RNA, 23 nt, Artificial Sequence
  Description of Artificial Sequence: Synthetic oligonucleotide
aagaucuccgcaaacacacauac

SEQ ID NO: 272 - RNA, 23 nt, Artificial Sequence
  Description of Artificial Sequence: Synthetic oligonucleotide
aaaaggccagaucuccgcaaaca

SEQ ID NO: 273 - RNA, 23 nt, Artificial Sequence
  Description of Artificial Sequence: Synthetic oligonucleotide
agagcaauaaaggccagaucucc

SEQ ID NO: 274 - RNA, 23 nt, Artificial Sequence
  Description of Artificial Sequence: Synthetic oligonucleotide
acuugguggagcaauaaaggcca

SEQ ID NO: 275 - RNA, 23 nt, Artificial Sequence
  Description of Artificial Sequence: Synthetic oligonucleotide
aaaguucccuugguggagcaaua

SEQ ID NO: 276 - RNA, 23 nt, Artificial Sequence
  Description of Artificial Sequence: Synthetic oligonucleotide
agcagcugcaggugucuggguuc

SEQ ID NO: 277 - RNA, 23 nt, Artificial Sequence
  Description of Artificial Sequence: Synthetic oligonucleotide
auugcuguccuccaggucggcca

SEQ ID NO: 278 - RNA, 23 nt, Artificial Sequence
  Description of Artificial Sequence: Synthetic oligonucleotide
agaagauguugcuguccuccagg

SEQ ID NO: 279 - RNA, 23 nt, Artificial Sequence
  Description of Artificial Sequence: Synthetic oligonucleotide
aucagggagaagauguugcuguc

SEQ ID NO: 280 - RNA, 23 nt, Artificial Sequence
  Description of Artificial Sequence: Synthetic oligonucleotide
accagcgaucagggagaagaugu

SEQ ID NO: 281 - RNA, 23 nt, Artificial Sequence
  Description of Artificial Sequence: Synthetic oligonucleotide
acuuccugccagcgaucagggag

SEQ ID NO: 282 - RNA, 23 nt, Artificial Sequence
  Description of Artificial Sequence: Synthetic oligonucleotide
auguacugcuuccugccagcgau

SEQ ID NO: 283 - RNA, 23 nt, Artificial Sequence
  Description of Artificial Sequence: Synthetic oligonucleotide
augcagagcccguggucuguagg

SEQ ID NO: 284 - RNA, 23 nt, Artificial Sequence
  Description of Artificial Sequence: Synthetic oligonucleotide
auuucauuccugacuuuguuugg

SEQ ID NO: 285 - RNA, 23 nt, Artificial Sequence
  Description of Artificial Sequence: Synthetic oligonucleotide
aucuuuaguuucauuccugacuu

SEQ ID NO: 286 - RNA, 23 nt, Artificial Sequence
  Description of Artificial Sequence: Synthetic oligonucleotide
accucagcucuuuaguuucauuc

SEQ ID NO: 287 - RNA, 23 nt, Artificial Sequence
  Description of Artificial Sequence: Synthetic oligonucleotide
aagagcaaccucagcucuuuagu

SEQ ID NO: 288 - RNA, 23 nt, Artificial Sequence
  Description of Artificial Sequence: Synthetic oligonucleotide
aucugcacagagcaaccucagcu

SEQ ID NO: 289 - RNA, 23 nt, Artificial Sequence
  Description of Artificial Sequence: Synthetic oligonucleotide
acucguccucugcacagagcaac

SEQ ID NO: 290 - RNA, 23 nt, Artificial Sequence
  Description of Artificial Sequence: Synthetic oligonucleotide
augguuugcucguccucugcaca

SEQ ID NO: 291 - RNA, 23 nt, Artificial Sequence
  Description of Artificial Sequence: Synthetic oligonucleotide
acacguccugguuugcucguccu

SEQ ID NO: 292 - RNA, 23 nt, Artificial Sequence
  Description of Artificial Sequence: Synthetic oligonucleotide
acauccagcacguccugguuugc

SEQ ID NO: 293 - RNA, 23 nt, Artificial Sequence
  Description of Artificial Sequence: Synthetic oligonucleotide
aacgcugucauccagcacguccu

SEQ ID NO: 294 - RNA, 23 nt, Artificial Sequence
  Description of Artificial Sequence: Synthetic oligonucleotide
aagucugaacgcugucauccagc

SEQ ID NO: 295 - RNA, 23 nt, Artificial Sequence
  Description of Artificial Sequence: Synthetic oligonucleotide
aucugguaaaggagcauuccaua

SEQ ID NO: 296 - RNA, 23 nt, Artificial Sequence
  Description of Artificial Sequence: Synthetic oligonucleotide
acgguaauucugguaaaggagca

SEQ ID NO: 297 - RNA, 23 nt, Artificial Sequence
  Description of Artificial Sequence: Synthetic oligonucleotide
aagggauucgguaauucugguaa

SEQ ID NO: 298 - RNA, 23 nt, Artificial Sequence
  Description of Artificial Sequence: Synthetic oligonucleotide
aucugcugagggauucgguaauu

SEQ ID NO: 299 - RNA, 23 nt, Artificial Sequence
  Description of Artificial Sequence: Synthetic oligonucleotide
agccuuccucugcugagggauuc

SEQ ID NO: 300 - RNA, 23 nt, Artificial Sequence
  Description of Artificial Sequence: Synthetic oligonucleotide
acagcaaggccuuccucugcuga

SEQ ID NO: 301 - RNA, 23 nt, Artificial Sequence
  Description of Artificial Sequence: Synthetic oligonucleotide
agggaguucucggagacacugcg

SEQ ID NO: 302 - RNA, 23 nt, Artificial Sequence
  Description of Artificial Sequence: Synthetic oligonucleotide
agccacgagggaguucucggaga

SEQ ID NO: 303 - RNA, 23 nt, Artificial Sequence
  Description of Artificial Sequence: Synthetic oligonucleotide
aauccauugccacgagggaguuc

SEQ ID NO: 304 - RNA, 23 nt, Artificial Sequence
  Description of Artificial Sequence: Synthetic oligonucleotide
acgcguccuguuugcccagaaaa

SEQ ID NO: 305 - RNA, 23 nt, Artificial Sequence
  Description of Artificial Sequence: Synthetic oligonucleotide
aucuaucacgcguccuguuugcc

SEQ ID NO: 306 - RNA, 23 nt, Artificial Sequence
  Description of Artificial Sequence: Synthetic oligonucleotide
acggauucucuaucacgcguccu

SEQ ID NO: 307 - RNA, 23 nt, Artificial Sequence
  Description of Artificial Sequence: Synthetic oligonucleotide
accucugccggauucucuaucac

SEQ ID NO: 308 - RNA, 23 nt, Artificial Sequence
  Description of Artificial Sequence: Synthetic oligonucleotide
acucugggccucugccggauucu

SEQ ID NO: 309 - RNA, 23 nt, Artificial Sequence
  Description of Artificial Sequence: Synthetic oligonucleotide
auguucauccgugugcuucgcuu

SEQ ID NO: 310 - RNA, 23 nt, Artificial Sequence
  Description of Artificial Sequence: Synthetic oligonucleotide
accuaggauguucauccgugugc

SEQ ID NO: 311 - RNA, 23 nt, Artificial Sequence
  Description of Artificial Sequence: Synthetic oligonucleotide
auuggcuaccuaggauguucauc

SEQ ID NO: 312 - RNA, 23 nt, Artificial Sequence
  Description of Artificial Sequence: Synthetic oligonucleotide
acuuaggguagaaggguggaggg

SEQ ID NO: 313 - RNA, 23 nt, Artificial Sequence
  Description of Artificial Sequence: Synthetic oligonucleotide
acagugcuguguccugugaauca

SEQ ID NO: 314 - RNA, 23 nt, Artificial Sequence
  Description of Artificial Sequence: Synthetic oligonucleotide
agugaaaccagugcuguguccug

SEQ ID NO: 315 - RNA, 23 nt, Artificial Sequence
  Description of Artificial Sequence: Synthetic oligonucleotide
auccucccgugaaaccagugcug

SEQ ID NO: 316 - RNA, 23 nt, Artificial Sequence
  Description of Artificial Sequence: Synthetic oligonucleotide
acuggagauccucccgugaaacc

SEQ ID NO: 317 - RNA, 23 nt, Artificial Sequence
  Description of Artificial Sequence: Synthetic oligonucleotide
auuccucccuggagauccucccg

SEQ ID NO: 318 - RNA, 23 nt, Artificial Sequence
  Description of Artificial Sequence: Synthetic oligonucleotide
augugggauuccucccuggagau

SEQ ID NO: 319 - RNA, 23 nt, Artificial Sequence
  Description of Artificial Sequence: Synthetic oligonucleotide
aaugauccugugggauuccuccc

SEQ ID NO: 320 - RNA, 23 nt, Artificial Sequence
  Description of Artificial Sequence: Synthetic oligonucleotide
acuguuuaaugauccugugggau

SEQ ID NO: 321 - RNA, 23 nt, Artificial Sequence
  Description of Artificial Sequence: Synthetic oligonucleotide
agcccuugcuguuuaaugauccu

SEQ ID NO: 322 - RNA, 23 nt, Artificial Sequence
  Description of Artificial Sequence: Synthetic oligonucleotide
auccacgagcccuugcuguuuaa

SEQ ID NO: 323 - RNA, 21 nt, Artificial Sequence
  Description of Artificial Sequence: Synthetic oligonucleotide
caagguggagcagacaccucu

SEQ ID NO: 324 - RNA, 21 nt, Artificial Sequence
  Description of Artificial Sequence: Synthetic oligonucleotide
gagcagacaccucgcagucau

SEQ ID NO: 325 - RNA, 21 nt, Artificial Sequence
  Description of Artificial Sequence: Synthetic oligonucleotide
caccucgcagucaacaagacu

SEQ ID NO: 326 - RNA, 21 nt, Artificial Sequence
  Description of Artificial Sequence: Synthetic oligonucleotide
cagucaacaagacccggcagu

SEQ ID NO: 327 - RNA, 21 nt, Artificial Sequence
  Description of Artificial Sequence: Synthetic oligonucleotide
caagacccggcaggaccaggu

SEQ ID NO: 328 - RNA, 21 nt, Artificial Sequence
  Description of Artificial Sequence: Synthetic oligonucleotide
cgcacagucugaccgacuugu

SEQ ID NO: 329 - RNA, 21 nt, Artificial Sequence
  Description of Artificial Sequence: Synthetic oligonucleotide
ucugaccgacuugcgaaucau

SEQ ID NO: 330 - RNA, 21 nt, Artificial Sequence
  Description of Artificial Sequence: Synthetic oligonucleotide
gaugauguggaccuggaagcu

SEQ ID NO: 331 - RNA, 21 nt, Artificial Sequence
  Description of Artificial Sequence: Synthetic oligonucleotide
uggaccuggaagcccuggugu

SEQ ID NO: 332 - RNA, 21 nt, Artificial Sequence
  Description of Artificial Sequence: Synthetic oligonucleotide
ggaagcccuggugaacgauau

SEQ ID NO: 333 - RNA, 21 nt, Artificial Sequence
  Description of Artificial Sequence: Synthetic oligonucleotide
cuggugaacgauaugaaugcu

SEQ ID NO: 334 - RNA, 21 nt, Artificial Sequence
  Description of Artificial Sequence: Synthetic oligonucleotide
acgauaugaaugcaucccugu

SEQ ID NO: 335 - RNA, 21 nt, Artificial Sequence
  Description of Artificial Sequence: Synthetic oligonucleotide
gaaugcaucccuggagagccu

SEQ ID NO: 336 - RNA, 21 nt, Artificial Sequence
  Description of Artificial Sequence: Synthetic oligonucleotide
ucccuggagagccuguacucu

SEQ ID NO: 337 - RNA, 21 nt, Artificial Sequence
  Description of Artificial Sequence: Synthetic oligonucleotide
gagccuguacucggccugcau

SEQ ID NO: 338 - RNA, 21 nt, Artificial Sequence
  Description of Artificial Sequence: Synthetic oligonucleotide
uacucggccugcagcaugcau

SEQ ID NO: 339 - RNA, 21 nt, Artificial Sequence
  Description of Artificial Sequence: Synthetic oligonucleotide
ccugcagcaugcagucagacu

SEQ ID NO: 340 - RNA, 21 nt, Artificial Sequence
  Description of Artificial Sequence: Synthetic oligonucleotide
caugcagucagacacggugcu

SEQ ID NO: 341 - RNA, 21 nt, Artificial Sequence
  Description of Artificial Sequence: Synthetic oligonucleotide
cuccugcagaauggccagcau

SEQ ID NO: 342 - RNA, 21 nt, Artificial Sequence
  Description of Artificial Sequence: Synthetic oligonucleotide
gaauggccagcaugcccgcau

SEQ ID NO: 343 - RNA, 21 nt, Artificial Sequence
  Description of Artificial Sequence: Synthetic oligonucleotide
ucaggcccuccucgguccauu

SEQ ID NO: 344 - RNA, 21 nt, Artificial Sequence
  Description of Artificial Sequence: Synthetic oligonucleotide
ccucgguccauccagccacau

SEQ ID NO: 345 - RNA, 21 nt, Artificial Sequence
  Description of Artificial Sequence: Synthetic oligonucleotide
ccauccagccacagguguccu

SEQ ID NO: 346 - RNA, 21 nt, Artificial Sequence
  Description of Artificial Sequence: Synthetic oligonucleotide
cgcucccagccugugcacauu

SEQ ID NO: 347 - RNA, 21 nt, Artificial Sequence
  Description of Artificial Sequence: Synthetic oligonucleotide
agccugugcacauccucgcuu

SEQ ID NO: 348 - RNA, 21 nt, Artificial Sequence
  Description of Artificial Sequence: Synthetic oligonucleotide
gccuucaggaggaagaccagu

SEQ ID NO: 349 - RNA, 21 nt, Artificial Sequence
  Description of Artificial Sequence: Synthetic oligonucleotide
ggaggaagaccagcaguuuau

SEQ ID NO: 350 - RNA, 21 nt, Artificial Sequence
  Description of Artificial Sequence: Synthetic oligonucleotide
gaccagcaguuuagaaccucu

SEQ ID NO: 351 - RNA, 21 nt, Artificial Sequence
  Description of Artificial Sequence: Synthetic oligonucleotide
aguuuagaaccucaucucugu

SEQ ID NO: 352 - RNA, 21 nt, Artificial Sequence
  Description of Artificial Sequence: Synthetic oligonucleotide
aaccucaucucugccggccau

SEQ ID NO: 353 - RNA, 21 nt, Artificial Sequence
  Description of Artificial Sequence: Synthetic oligonucleotide
caauccuuuuccugaacucuu

SEQ ID NO: 354 - RNA, 21 nt, Artificial Sequence
  Description of Artificial Sequence: Synthetic oligonucleotide
uuuccugaacucuguggcccu

SEQ ID NO: 355 - RNA, 21 nt, Artificial Sequence
  Description of Artificial Sequence: Synthetic oligonucleotide
aacucuguggcccugggagcu

SEQ ID NO: 356 - RNA, 21 nt, Artificial Sequence
  Description of Artificial Sequence: Synthetic oligonucleotide
ugugcucacgccggguucuuu

SEQ ID NO: 357 - RNA, 21 nt, Artificial Sequence
  Description of Artificial Sequence: Synthetic oligonucleotide
acgccggguucuuuaccuccu

SEQ ID NO: 358 - RNA, 21 nt, Artificial Sequence
  Description of Artificial Sequence: Synthetic oligonucleotide
guucuuuaccuccgagccagu

SEQ ID NO: 359 - RNA, 21 nt, Artificial Sequence
  Description of Artificial Sequence: Synthetic oligonucleotide
uguuaaagucuuuagugaagu

SEQ ID NO: 360 - RNA, 21 nt, Artificial Sequence
  Description of Artificial Sequence: Synthetic oligonucleotide
gucuuuagugaagaugggacu

SEQ ID NO: 361 - RNA, 21 nt, Artificial Sequence
  Description of Artificial Sequence: Synthetic oligonucleotide
gugaagaugggacaagcaaau

SEQ ID NO: 362 - RNA, 21 nt, Artificial Sequence
  Description of Artificial Sequence: Synthetic oligonucleotide
ugggacaagcaaagugguggu

SEQ ID NO: 363 - RNA, 21 nt, Artificial Sequence
  Description of Artificial Sequence: Synthetic oligonucleotide
agcaaagugguggagauucuu

SEQ ID NO: 364 - RNA, 21 nt, Artificial Sequence
  Description of Artificial Sequence: Synthetic oligonucleotide
ugguggagauucuagcagacu

SEQ ID NO: 365 - RNA, 21 nt, Artificial Sequence
  Description of Artificial Sequence: Synthetic oligonucleotide
gauucuagcagacaugacagu

SEQ ID NO: 366 - RNA, 21 nt, Artificial Sequence
  Description of Artificial Sequence: Synthetic oligonucleotide
gcagacaugacagccagagau

SEQ ID NO: 367 - RNA, 21 nt, Artificial Sequence
  Description of Artificial Sequence: Synthetic oligonucleotide
ugacagccagagaccugugcu

SEQ ID NO: 368 - RNA, 21 nt, Artificial Sequence
  Description of Artificial Sequence: Synthetic oligonucleotide
cagagaccugugccaauugcu

SEQ ID NO: 369 - RNA, 21 nt, Artificial Sequence
  Description of Artificial Sequence: Synthetic oligonucleotide
cugugccaauugcugguuuau

SEQ ID NO: 370 - RNA, 21 nt, Artificial Sequence
  Description of Artificial Sequence: Synthetic oligonucleotide
aauugcugguuuacaaaaguu

SEQ ID NO: 371 - RNA, 21 nt, Artificial Sequence
  Description of Artificial Sequence: Synthetic oligonucleotide
gguuuacaaaagucacugugu

SEQ ID NO: 372 - RNA, 21 nt, Artificial Sequence
  Description of Artificial Sequence: Synthetic oligonucleotide
aaaagucacuguguggaugau

SEQ ID NO: 373 - RNA, 21 nt, Artificial Sequence
  Description of Artificial Sequence: Synthetic oligonucleotide
acuguguggaugacaacagcu

SEQ ID NO: 374 - RNA, 21 nt, Artificial Sequence
  Description of Artificial Sequence: Synthetic oligonucleotide
ggaugacaacagcuggacacu

SEQ ID NO: 375 - RNA, 21 nt, Artificial Sequence
  Description of Artificial Sequence: Synthetic oligonucleotide
aacagcuggacacuaguggau

SEQ ID NO: 376 - RNA, 21 nt, Artificial Sequence
  Description of Artificial Sequence: Synthetic oligonucleotide
ggacacuaguggagcaccacu

SEQ ID NO: 377 - RNA, 21 nt, Artificial Sequence
  Description of Artificial Sequence: Synthetic oligonucleotide
guggagcaccacccgcaccuu

SEQ ID NO: 378 - RNA, 21 nt, Artificial Sequence
  Description of Artificial Sequence: Synthetic oligonucleotide
accacccgcaccuaggauuau

SEQ ID NO: 379 - RNA, 21 nt, Artificial Sequence
  Description of Artificial Sequence: Synthetic oligonucleotide
aggugcuuggaagaccaugau

SEQ ID NO: 380 - RNA, 21 nt, Artificial Sequence
  Description of Artificial Sequence: Synthetic oligonucleotide
uggaagaccaugagcuggugu

SEQ ID NO: 381 - RNA, 21 nt, Artificial Sequence
  Description of Artificial Sequence: Synthetic oligonucleotide
ccaugagcuggugguccaggu

SEQ ID NO: 382 - RNA, 21 nt, Artificial Sequence
  Description of Artificial Sequence: Synthetic oligonucleotide
cuggugguccagguggagagu

SEQ ID NO: 383 - RNA, 21 nt, Artificial Sequence
  Description of Artificial Sequence: Synthetic oligonucleotide
uccagguggagaguaccaugu

SEQ ID NO: 384 - RNA, 21 nt, Artificial Sequence
  Description of Artificial Sequence: Synthetic oligonucleotide
ggagaguaccauggccagugu

SEQ ID NO: 385 - RNA, 21 nt, Artificial Sequence
  Description of Artificial Sequence: Synthetic oligonucleotide
accauggccagugagaguaau

SEQ ID NO: 386 - RNA, 21 nt, Artificial Sequence
  Description of Artificial Sequence: Synthetic oligonucleotide
ccagugagaguaaauuucuau

SEQ ID NO: 387 - RNA, 21 nt, Artificial Sequence
  Description of Artificial Sequence: Synthetic oligonucleotide
gaguaaauuucuauucaggau

SEQ ID NO: 388 - RNA, 21 nt, Artificial Sequence
  Description of Artificial Sequence: Synthetic oligonucleotide
uucuauucaggaagaauuacu

SEQ ID NO: 389 - RNA, 21 nt, Artificial Sequence
  Description of Artificial Sequence: Synthetic oligonucleotide
caggaagaauuacgcaaaauu

SEQ ID NO: 390 - RNA, 21 nt, Artificial Sequence
  Description of Artificial Sequence: Synthetic oligonucleotide
aauuacgcaaaauacgaguuu

SEQ ID NO: 391 - RNA, 21 nt, Artificial Sequence
  Description of Artificial Sequence: Synthetic oligonucleotide
caaaauacgaguucuuuaaau

SEQ ID NO: 392 - RNA, 21 nt, Artificial Sequence
  Description of Artificial Sequence: Synthetic oligonucleotide
uuucuucccagaacagauggu

SEQ ID NO: 393 - RNA, 21 nt, Artificial Sequence
  Description of Artificial Sequence: Synthetic oligonucleotide
ccagaacagaugguuacuugu

SEQ ID NO: 394 - RNA, 21 nt, Artificial Sequence
  Description of Artificial Sequence: Synthetic oligonucleotide
agaugguuacuuggugccagu

SEQ ID NO: 395 - RNA, 21 nt, Artificial Sequence
  Description of Artificial Sequence: Synthetic oligonucleotide
uacuuggugccagcagucaau

SEQ ID NO: 396 - RNA, 21 nt, Artificial Sequence
  Description of Artificial Sequence: Synthetic oligonucleotide
ugccagcagucaaauggcagu

SEQ ID NO: 397 - RNA, 21 nt, Artificial Sequence
  Description of Artificial Sequence: Synthetic oligonucleotide
agucaaauggcagucaaaccu

SEQ ID NO: 398 - RNA, 21 nt, Artificial Sequence
  Description of Artificial Sequence: Synthetic oligonucleotide
uggcagucaaacccagcuuuu

SEQ ID NO: 399 - RNA, 21 nt, Artificial Sequence
  Description of Artificial Sequence: Synthetic oligonucleotide
uuuucugaacuccaguaguuu

SEQ ID NO: 400 - RNA, 21 nt, Artificial Sequence
  Description of Artificial Sequence: Synthetic oligonucleotide
aacuccaguaguuguccugau

SEQ ID NO: 401 - RNA, 21 nt, Artificial Sequence
  Description of Artificial Sequence: Synthetic oligonucleotide
guaguuguccugaaauucaau

SEQ ID NO: 402 - RNA, 21 nt, Artificial Sequence
  Description of Artificial Sequence: Synthetic oligonucleotide
uugcaugugaaagagcugggu

SEQ ID NO: 403 - RNA, 21 nt, Artificial Sequence
  Description of Artificial Sequence: Synthetic oligonucleotide
ugaaagagcugggaaagaaau

SEQ ID NO: 404 - RNA, 21 nt, Artificial Sequence
  Description of Artificial Sequence: Synthetic oligonucleotide
gcugggaaagaaaucauggau

SEQ ID NO: 405 - RNA, 21 nt, Artificial Sequence
  Description of Artificial Sequence: Synthetic oligonucleotide
aagcuguauguguguuugcgu

SEQ ID NO: 406 - RNA, 21 nt, Artificial Sequence
  Description of Artificial Sequence: Synthetic oligonucleotide
auguguguuugcggagaucuu

SEQ ID NO: 407 - RNA, 21 nt, Artificial Sequence
  Description of Artificial Sequence: Synthetic oligonucleotide
uuugcggagaucuggccuuuu

SEQ ID NO: 408 - RNA, 21 nt, Artificial Sequence
  Description of Artificial Sequence: Synthetic oligonucleotide
agaucuggccuuuauugcucu

SEQ ID NO: 409 - RNA, 21 nt, Artificial Sequence
  Description of Artificial Sequence: Synthetic oligonucleotide
gccuuuauugcuccaccaagu

SEQ ID NO: 410 - RNA, 21 nt, Artificial Sequence
  Description of Artificial Sequence: Synthetic oligonucleotide
uugcuccaccaagggaacuuu

SEQ ID NO: 411 - RNA, 21 nt, Artificial Sequence
  Description of Artificial Sequence: Synthetic oligonucleotide
acccagacaccugcagcugcu

SEQ ID NO: 412 - RNA, 21 nt, Artificial Sequence
  Description of Artificial Sequence: Synthetic oligonucleotide
gccgaccuggaggacagcaau

SEQ ID NO: 413 - RNA, 21 nt, Artificial Sequence
  Description of Artificial Sequence: Synthetic oligonucleotide
uggaggacagcaacaucuucu

SEQ ID NO: 414 - RNA, 21 nt, Artificial Sequence
  Description of Artificial Sequence: Synthetic oligonucleotide
cagcaacaucuucucccugau

SEQ ID NO: 415 - RNA, 21 nt, Artificial Sequence
  Description of Artificial Sequence: Synthetic oligonucleotide
aucuucucccugaucgcuggu

SEQ ID NO: 416 - RNA, 21 nt, Artificial Sequence
  Description of Artificial Sequence: Synthetic oligonucleotide
cccugaucgcuggcaggaagu

SEQ ID NO: 417 - RNA, 21 nt, Artificial Sequence
  Description of Artificial Sequence: Synthetic oligonucleotide
cgcuggcaggaagcaguacau

SEQ ID NO: 418 - RNA, 21 nt, Artificial Sequence
  Description of Artificial Sequence: Synthetic oligonucleotide
uacagaccacgggcucugcau

SEQ ID NO: 419 - RNA, 21 nt, Artificial Sequence
  Description of Artificial Sequence: Synthetic oligonucleotide
aaacaaagucaggaaugaaau

SEQ ID NO: 420 - RNA, 21 nt, Artificial Sequence
  Description of Artificial Sequence: Synthetic oligonucleotide
gucaggaaugaaacuaaagau

SEQ ID NO: 421 - RNA, 21 nt, Artificial Sequence
  Description of Artificial Sequence: Synthetic oligonucleotide
augaaacuaaagagcugaggu

SEQ ID NO: 422 - RNA, 21 nt, Artificial Sequence
  Description of Artificial Sequence: Synthetic oligonucleotide
uaaagagcugagguugcucuu

SEQ ID NO: 423 - RNA, 21 nt, Artificial Sequence
  Description of Artificial Sequence: Synthetic oligonucleotide
cugagguugcucugugcagau

SEQ ID NO: 424 - RNA, 21 nt, Artificial Sequence
  Description of Artificial Sequence: Synthetic oligonucleotide
ugcucugugcagaggacgagu

SEQ ID NO: 425 - RNA, 21 nt, Artificial Sequence
  Description of Artificial Sequence: Synthetic oligonucleotide
ugcagaggacgagcaaaccau

SEQ ID NO: 426 - RNA, 21 nt, Artificial Sequence
  Description of Artificial Sequence: Synthetic oligonucleotide
gacgagcaaaccaggacgugu

SEQ ID NO: 427 - RNA, 21 nt, Artificial Sequence
  Description of Artificial Sequence: Synthetic oligonucleotide
aaaccaggacgugcuggaugu

SEQ ID NO: 428 - RNA, 21 nt, Artificial Sequence
  Description of Artificial Sequence: Synthetic oligonucleotide
gacgugcuggaugacagcguu

SEQ ID NO: 429 - RNA, 21 nt, Artificial Sequence
  Description of Artificial Sequence: Synthetic oligonucleotide
uggaugacagcguucagacuu

SEQ ID NO: 430 - RNA, 21 nt, Artificial Sequence
  Description of Artificial Sequence: Synthetic oligonucleotide
uggaaugcuccuuuaccagau

SEQ ID NO: 431 - RNA, 21 nt, Artificial Sequence
  Description of Artificial Sequence: Synthetic oligonucleotide
cuccuuuaccagaauuaccgu

SEQ ID NO: 432 - RNA, 21 nt, Artificial Sequence
  Description of Artificial Sequence: Synthetic oligonucleotide
accagaauuaccgaaucccuu

SEQ ID NO: 433 - RNA, 21 nt, Artificial Sequence
  Description of Artificial Sequence: Synthetic oligonucleotide
uuaccgaaucccucagcagau

SEQ ID NO: 434 - RNA, 21 nt, Artificial Sequence
  Description of Artificial Sequence: Synthetic oligonucleotide
aucccucagcagaggaaggcu

SEQ ID NO: 435 - RNA, 21 nt, Artificial Sequence
  Description of Artificial Sequence: Synthetic oligonucleotide
agcagaggaaggccuugcugu

SEQ ID NO: 436 - RNA, 21 nt, Artificial Sequence
  Description of Artificial Sequence: Synthetic oligonucleotide
cagugucuccgagaacucccu

SEQ ID NO: 437 - RNA, 21 nt, Artificial Sequence
  Description of Artificial Sequence: Synthetic oligonucleotide
uccgagaacucccucguggcu

SEQ ID NO: 438 - RNA, 21 nt, Artificial Sequence
  Description of Artificial Sequence: Synthetic oligonucleotide
acucccucguggcaauggauu

SEQ ID NO: 439 - RNA, 21 nt, Artificial Sequence
  Description of Artificial Sequence: Synthetic oligonucleotide
uucugggcaaacaggacgcgu

SEQ ID NO: 440 - RNA, 21 nt, Artificial Sequence
  Description of Artificial Sequence: Synthetic oligonucleotide
caaacaggacgcgugauagau

SEQ ID NO: 441 - RNA, 21 nt, Artificial Sequence
  Description of Artificial Sequence: Synthetic oligonucleotide
gacgcgugauagagaauccgu

SEQ ID NO: 442 - RNA, 21 nt, Artificial Sequence
  Description of Artificial Sequence: Synthetic oligonucleotide
gauagagaauccggcagaggu

SEQ ID NO: 443 - RNA, 21 nt, Artificial Sequence
  Description of Artificial Sequence: Synthetic oligonucleotide
aauccggcagaggcccagagu

SEQ ID NO: 444 - RNA, 21 nt, Artificial Sequence
  Description of Artificial Sequence: Synthetic oligonucleotide
gcgaagcacacggaugaacau

SEQ ID NO: 445 - RNA, 21 nt, Artificial Sequence
  Description of Artificial Sequence: Synthetic oligonucleotide
acacggaugaacauccuaggu

SEQ ID NO: 446 - RNA, 21 nt, Artificial Sequence
  Description of Artificial Sequence: Synthetic oligonucleotide
ugaacauccuagguagccaau

SEQ ID NO: 447 - RNA, 21 nt, Artificial Sequence
  Description of Artificial Sequence: Synthetic oligonucleotide
cuccacccuucuacccuaagu

SEQ ID NO: 448 - RNA, 21 nt, Artificial Sequence
  Description of Artificial Sequence: Synthetic oligonucleotide
auucacaggacacagcacugu

SEQ ID NO: 449 - RNA, 21 nt, Artificial Sequence
  Description of Artificial Sequence: Synthetic oligonucleotide
ggacacagcacugguuucacu

SEQ ID NO: 450 - RNA, 21 nt, Artificial Sequence
  Description of Artificial Sequence: Synthetic oligonucleotide
gcacugguuucacgggaggau

SEQ ID NO: 451 - RNA, 21 nt, Artificial Sequence
  Description of Artificial Sequence: Synthetic oligonucleotide
uuucacgggaggaucuccagu

SEQ ID NO: 452 - RNA, 21 nt, Artificial Sequence
  Description of Artificial Sequence: Synthetic oligonucleotide
ggaggaucuccagggaggaau

SEQ ID NO: 453 - RNA, 21 nt, Artificial Sequence
  Description of Artificial Sequence: Synthetic oligonucleotide
cuccagggaggaaucccacau

SEQ ID NO: 454 - RNA, 21 nt, Artificial Sequence
  Description of Artificial Sequence: Synthetic oligonucleotide
gaggaaucccacaggaucauu

SEQ ID NO: 455 - RNA, 21 nt, Artificial Sequence
  Description of Artificial Sequence: Synthetic oligonucleotide
cccacaggaucauuaaacagu

SEQ ID NO: 456 - RNA, 21 nt, Artificial Sequence
  Description of Artificial Sequence: Synthetic oligonucleotide
gaucauuaaacagcaagggcu

SEQ ID NO: 457 - RNA, 21 nt, Artificial Sequence
  Description of Artificial Sequence: Synthetic oligonucleotide
aaacagcaagggcucguggau

SEQ ID NO: 458 - RNA, 23 nt, Artificial Sequence
  Description of Artificial Sequence: Synthetic oligonucleotide
agaggugucugcuccaccuuguc

SEQ ID NO: 459 - RNA, 23 nt, Artificial Sequence
  Description of Artificial Sequence: Synthetic oligonucleotide
augacugcgaggugucugcucca

SEQ ID NO: 460 - RNA, 23 nt, Artificial Sequence
  Description of Artificial Sequence: Synthetic oligonucleotide
agucuuguugacugcgagguguc

SEQ ID NO: 461 - RNA, 23 nt, Artificial Sequence
  Description of Artificial Sequence: Synthetic oligonucleotide
acugccgggucuuguugacugcg

SEQ ID NO: 462 - RNA, 23 nt, Artificial Sequence
  Description of Artificial Sequence: Synthetic oligonucleotide
accugguccugccgggucuuguu

SEQ ID NO: 463 - RNA, 23 nt, Artificial Sequence
  Description of Artificial Sequence: Synthetic oligonucleotide
acaagucggucagacugugcggg

SEQ ID NO: 464 - RNA, 23 nt, Artificial Sequence
  Description of Artificial Sequence: Synthetic oligonucleotide
augauucgcaagucggucagacu

SEQ ID NO: 465 - RNA, 23 nt, Artificial Sequence
  Description of Artificial Sequence: Synthetic oligonucleotide
agcuuccagguccacaucauccu

SEQ ID NO: 466 - RNA, 23 nt, Artificial Sequence
  Description of Artificial Sequence: Synthetic oligonucleotide
acaccagggcuuccagguccaca

SEQ ID NO: 467 - RNA, 23 nt, Artificial Sequence
  Description of Artificial Sequence: Synthetic oligonucleotide
auaucguucaccagggcuuccag

SEQ ID NO: 468 - RNA, 23 nt, Artificial Sequence
  Description of Artificial Sequence: Synthetic oligonucleotide
agcauucauaucguucaccaggg

SEQ ID NO: 469 - RNA, 23 nt, Artificial Sequence
  Description of Artificial Sequence: Synthetic oligonucleotide
acagggaugcauucauaucguuc

SEQ ID NO: 470 - RNA, 23 nt, Artificial Sequence
  Description of Artificial Sequence: Synthetic oligonucleotide
aggcucuccagggaugcauucau

SEQ ID NO: 471 - RNA, 23 nt, Artificial Sequence
  Description of Artificial Sequence: Synthetic oligonucleotide
agaguacaggcucuccagggaug

SEQ ID NO: 472 - RNA, 23 nt, Artificial Sequence
  Description of Artificial Sequence: Synthetic oligonucleotide
augcaggccgaguacaggcucuc

SEQ ID NO: 473 - RNA, 23 nt, Artificial Sequence
  Description of Artificial Sequence: Synthetic oligonucleotide
augcaugcugcaggccgaguaca

SEQ ID NO: 474 - RNA, 23 nt, Artificial Sequence
  Description of Artificial Sequence: Synthetic oligonucleotide
agucugacugcaugcugcaggcc

SEQ ID NO: 475 - RNA, 23 nt, Artificial Sequence
  Description of Artificial Sequence: Synthetic oligonucleotide
agcaccgugucugacugcaugcu

SEQ ID NO: 476 - RNA, 23 nt, Artificial Sequence
  Description of Artificial Sequence: Synthetic oligonucleotide
augcuggccauucugcaggaggg

SEQ ID NO: 477 - RNA, 23 nt, Artificial Sequence
  Description of Artificial Sequence: Synthetic oligonucleotide
augcgggcaugcuggccauucug

SEQ ID NO: 478 - RNA, 23 nt, Artificial Sequence
  Description of Artificial Sequence: Synthetic oligonucleotide
aauggaccgaggagggccugaag

SEQ ID NO: 479 - RNA, 23 nt, Artificial Sequence
  Description of Artificial Sequence: Synthetic oligonucleotide
auguggcuggauggaccgaggag

SEQ ID NO: 480 - RNA, 23 nt, Artificial Sequence
  Description of Artificial Sequence: Synthetic oligonucleotide
aggacaccuguggcuggauggac

SEQ ID NO: 481 - RNA, 23 nt, Artificial Sequence
  Description of Artificial Sequence: Synthetic oligonucleotide
aaugugcacaggcugggagcgcu

SEQ ID NO: 482 - RNA, 23 nt, Artificial Sequence
  Description of Artificial Sequence: Synthetic oligonucleotide
aagcgaggaugugcacaggcugg

SEQ ID NO: 483 - RNA, 23 nt, Artificial Sequence
  Description of Artificial Sequence: Synthetic oligonucleotide
acuggucuuccuccugaaggcgc

SEQ ID NO: 484 - RNA, 23 nt, Artificial Sequence
  Description of Artificial Sequence: Synthetic oligonucleotide
auaaacugcuggucuuccuccug

SEQ ID NO: 485 - RNA, 23 nt, Artificial Sequence
  Description of Artificial Sequence: Synthetic oligonucleotide
agagguucuaaacugcuggucuu

SEQ ID NO: 486 - RNA, 23 nt, Artificial Sequence
  Description of Artificial Sequence: Synthetic oligonucleotide
acagagaugagguucuaaacugc

SEQ ID NO: 487 - RNA, 23 nt, Artificial Sequence
  Description of Artificial Sequence: Synthetic oligonucleotide
auggccggcagagaugagguucu

SEQ ID NO: 488 - RNA, 23 nt, Artificial Sequence
  Description of Artificial Sequence: Synthetic oligonucleotide
aagaguucaggaaaaggauuggg

SEQ ID NO: 489 - RNA, 23 nt, Artificial Sequence
  Description of Artificial Sequence: Synthetic oligonucleotide
agggccacagaguucaggaaaag

SEQ ID NO: 490 - RNA, 23 nt, Artificial Sequence
  Description of Artificial Sequence: Synthetic oligonucleotide
agcucccagggccacagaguuca

SEQ ID NO: 491 - RNA, 23 nt, Artificial Sequence
  Description of Artificial Sequence: Synthetic oligonucleotide
aaagaacccggcgugagcacagg

SEQ ID NO: 492 - RNA, 23 nt, Artificial Sequence
  Description of Artificial Sequence: Synthetic oligonucleotide
aggagguaaagaacccggcguga

SEQ ID NO: 493 - RNA, 23 nt, Artificial Sequence
  Description of Artificial Sequence: Synthetic oligonucleotide
acuggcucggagguaaagaaccc

SEQ ID NO: 494 - RNA, 23 nt, Artificial Sequence
  Description of Artificial Sequence: Synthetic oligonucleotide
acuucacuaaagacuuuaacauc

SEQ ID NO: 495 - RNA, 23 nt, Artificial Sequence
  Description of Artificial Sequence: Synthetic oligonucleotide
agucccaucuucacuaaagacuu

SEQ ID NO: 496 - RNA, 23 nt, Artificial Sequence
  Description of Artificial Sequence: Synthetic oligonucleotide
auuugcuugucccaucuucacua

SEQ ID NO: 497 - RNA, 23 nt, Artificial Sequence
  Description of Artificial Sequence: Synthetic oligonucleotide
accaccacuuugcuugucccauc

SEQ ID NO: 498 - RNA, 23 nt, Artificial Sequence
  Description of Artificial Sequence: Synthetic oligonucleotide
aagaaucuccaccacuuugcuug

SEQ ID NO: 499 - RNA, 23 nt, Artificial Sequence
  Description of Artificial Sequence: Synthetic oligonucleotide
agucugcuagaaucuccaccacu

SEQ ID NO: 500 - RNA, 23 nt, Artificial Sequence
  Description of Artificial Sequence: Synthetic oligonucleotide
acugucaugucugcuagaaucuc

SEQ ID NO: 501 - RNA, 23 nt, Artificial Sequence
  Description of Artificial Sequence: Synthetic oligonucleotide
aucucuggcugucaugucugcua

SEQ ID NO: 502 - RNA, 23 nt, Artificial Sequence
  Description of Artificial Sequence: Synthetic oligonucleotide
agcacaggucucuggcugucaug

SEQ ID NO: 503 - RNA, 23 nt, Artificial Sequence
  Description of Artificial Sequence: Synthetic oligonucleotide
agcaauuggcacaggucucuggc

SEQ ID NO: 504 - RNA, 23 nt, Artificial Sequence
  Description of Artificial Sequence: Synthetic oligonucleotide
auaaaccagcaauuggcacaggu

SEQ ID NO: 505 - RNA, 23 nt, Artificial Sequence
  Description of Artificial Sequence: Synthetic oligonucleotide
aacuuuuguaaaccagcaauugg

SEQ ID NO: 506 - RNA, 23 nt, Artificial Sequence
  Description of Artificial Sequence: Synthetic oligonucleotide
acacagugacuuuuguaaaccag

SEQ ID NO: 507 - RNA, 23 nt, Artificial Sequence
  Description of Artificial Sequence: Synthetic oligonucleotide
aucauccacacagugacuuuugu

SEQ ID NO: 508 - RNA, 23 nt, Artificial Sequence
  Description of Artificial Sequence: Synthetic oligonucleotide
agcuguugucauccacacaguga

SEQ ID NO: 509 - RNA, 23 nt, Artificial Sequence
  Description of Artificial Sequence: Synthetic oligonucleotide
aguguccagcuguugucauccac

SEQ ID NO: 510 - RNA, 23 nt, Artificial Sequence
  Description of Artificial Sequence: Synthetic oligonucleotide
auccacuaguguccagcuguugu

SEQ ID NO: 511 - RNA, 23 nt, Artificial Sequence
  Description of Artificial Sequence: Synthetic oligonucleotide
aguggugcuccacuaguguccag

SEQ ID NO: 512 - RNA, 23 nt, Artificial Sequence
  Description of Artificial Sequence: Synthetic oligonucleotide
aaggugcggguggugcuccacua

SEQ ID NO: 513 - RNA, 23 nt, Artificial Sequence
  Description of Artificial Sequence: Synthetic oligonucleotide
auaauccuaggugcggguggugc

SEQ ID NO: 514 - RNA, 23 nt, Artificial Sequence
  Description of Artificial Sequence: Synthetic oligonucleotide
aucauggucuuccaagcaccucu

SEQ ID NO: 515 - RNA, 23 nt, Artificial Sequence
  Description of Artificial Sequence: Synthetic oligonucleotide
acaccagcucauggucuuccaag

SEQ ID NO: 516 - RNA, 23 nt, Artificial Sequence
  Description of Artificial Sequence: Synthetic oligonucleotide
accuggaccaccagcucaugguc

SEQ ID NO: 517 - RNA, 23 nt, Artificial Sequence
  Description of Artificial Sequence: Synthetic oligonucleotide
acucuccaccuggaccaccagcu

SEQ ID NO: 518 - RNA, 23 nt, Artificial Sequence
  Description of Artificial Sequence: Synthetic oligonucleotide
acaugguacucuccaccuggacc

SEQ ID NO: 519 - RNA, 23 nt, Artificial Sequence
  Description of Artificial Sequence: Synthetic oligonucleotide
acacuggccaugguacucuccac

SEQ ID NO: 520 - RNA, 23 nt, Artificial Sequence
  Description of Artificial Sequence: Synthetic oligonucleotide
auuacucucacuggccaugguac

SEQ ID NO: 521 - RNA, 23 nt, Artificial Sequence
  Description of Artificial Sequence: Synthetic oligonucleotide
auagaaauuuacucucacuggcc

SEQ ID NO: 522 - RNA, 23 nt, Artificial Sequence
  Description of Artificial Sequence: Synthetic oligonucleotide
auccugaauagaaauuuacucuc

SEQ ID NO: 523 - RNA, 23 nt, Artificial Sequence
  Description of Artificial Sequence: Synthetic oligonucleotide
aguaauucuuccugaauagaaau

SEQ ID NO: 524 - RNA, 23 nt, Artificial Sequence
  Description of Artificial Sequence: Synthetic oligonucleotide
aauuuugcguaauucuuccugaa

SEQ ID NO: 525 - RNA, 23 nt, Artificial Sequence
  Description of Artificial Sequence: Synthetic oligonucleotide
aaacucguauuuugcguaauucu

SEQ ID NO: 526 - RNA, 23 nt, Artificial Sequence
  Description of Artificial Sequence: Synthetic oligonucleotide
auuuaaagaacucguauuuugcg

SEQ ID NO: 527 - RNA, 23 nt, Artificial Sequence
  Description of Artificial Sequence: Synthetic oligonucleotide
accaucuguucugggaagaaauu

SEQ ID NO: 528 - RNA, 23 nt, Artificial Sequence
  Description of Artificial Sequence: Synthetic oligonucleotide
acaaguaaccaucuguucuggga

SEQ ID NO: 529 - RNA, 23 nt, Artificial Sequence
  Description of Artificial Sequence: Synthetic oligonucleotide
acuggcaccaaguaaccaucugu

SEQ ID NO: 530 - RNA, 23 nt, Artificial Sequence
  Description of Artificial Sequence: Synthetic oligonucleotide
auugacugcuggcaccaaguaac

SEQ ID NO: 531 - RNA, 23 nt, Artificial Sequence
  Description of Artificial Sequence: Synthetic oligonucleotide
acugccauuugacugcuggcacc

SEQ ID NO: 532 - RNA, 23 nt, Artificial Sequence
  Description of Artificial Sequence: Synthetic oligonucleotide
agguuugacugccauuugacugc

SEQ ID NO: 533 - RNA, 23 nt, Artificial Sequence
  Description of Artificial Sequence: Synthetic oligonucleotide
aaaagcuggguuugacugccauu

SEQ ID NO: 534 - RNA, 23 nt, Artificial Sequence
  Description of Artificial Sequence: Synthetic oligonucleotide
aaacuacuggaguucagaaaauu

SEQ ID NO: 535 - RNA, 23 nt, Artificial Sequence
  Description of Artificial Sequence: Synthetic oligonucleotide
aucaggacaacuacuggaguuca

SEQ ID NO: 536 - RNA, 23 nt, Artificial Sequence
  Description of Artificial Sequence: Synthetic oligonucleotide
auugaauuucaggacaacuacug

SEQ ID NO: 537 - RNA, 23 nt, Artificial Sequence
  Description of Artificial Sequence: Synthetic oligonucleotide
acccagcucuuucacaugcaaaa

SEQ ID NO: 538 - RNA, 23 nt, Artificial Sequence
  Description of Artificial Sequence: Synthetic oligonucleotide
auuucuuucccagcucuuucaca

SEQ ID NO: 539 - RNA, 23 nt, Artificial Sequence
  Description of Artificial Sequence: Synthetic oligonucleotide
auccaugauuucuuucccagcuc

SEQ ID NO: 540 - RNA, 23 nt, Artificial Sequence
  Description of Artificial Sequence: Synthetic oligonucleotide
acgcaaacacacauacagcuuuu

SEQ ID NO: 541 - RNA, 23 nt, Artificial Sequence
  Description of Artificial Sequence: Synthetic oligonucleotide
aagaucuccgcaaacacacauac

SEQ ID NO: 542 - RNA, 23 nt, Artificial Sequence
  Description of Artificial Sequence: Synthetic oligonucleotide
aaaaggccagaucuccgcaaaca

SEQ ID NO: 543 - RNA, 23 nt, Artificial Sequence
  Description of Artificial Sequence: Synthetic oligonucleotide
agagcaauaaaggccagaucucc

SEQ ID NO: 544 - RNA, 23 nt, Artificial Sequence
  Description of Artificial Sequence: Synthetic oligonucleotide
acuugguggagcaauaaaggcca

SEQ ID NO: 545 - RNA, 23 nt, Artificial Sequence
  Description of Artificial Sequence: Synthetic oligonucleotide
aaaguucccuugguggagcaaua

SEQ ID NO: 546 - RNA, 23 nt, Artificial Sequence
  Description of Artificial Sequence: Synthetic oligonucleotide
agcagcugcaggugucuggguuc

SEQ ID NO: 547 - RNA, 23 nt, Artificial Sequence
  Description of Artificial Sequence: Synthetic oligonucleotide
auugcuguccuccaggucggcca

SEQ ID NO: 548 - RNA, 23 nt, Artificial Sequence
  Description of Artificial Sequence: Synthetic oligonucleotide
agaagauguugcuguccuccagg

SEQ ID NO: 549 - RNA, 23 nt, Artificial Sequence
  Description of Artificial Sequence: Synthetic oligonucleotide
aucagggagaagauguugcuguc

SEQ ID NO: 550 - RNA, 23 nt, Artificial Sequence
  Description of Artificial Sequence: Synthetic oligonucleotide
accagcgaucagggagaagaugu

SEQ ID NO: 551 - RNA, 23 nt, Artificial Sequence
  Description of Artificial Sequence: Synthetic oligonucleotide
acuuccugccagcgaucagggag

SEQ ID NO: 552 - RNA, 23 nt, Artificial Sequence
  Description of Artificial Sequence: Synthetic oligonucleotide
auguacugcuuccugccagcgau

SEQ ID NO: 553 - RNA, 23 nt, Artificial Sequence
  Description of Artificial Sequence: Synthetic oligonucleotide
augcagagcccguggucuguagg

SEQ ID NO: 554 - RNA, 23 nt, Artificial Sequence
  Description of Artificial Sequence: Synthetic oligonucleotide
auuucauuccugacuuuguuugg

SEQ ID NO: 555 - RNA, 23 nt, Artificial Sequence
  Description of Artificial Sequence: Synthetic oligonucleotide
aucuuuaguuucauuccugacuu

SEQ ID NO: 556 - RNA, 23 nt, Artificial Sequence
  Description of Artificial Sequence: Synthetic oligonucleotide
accucagcucuuuaguuucauuc

SEQ ID NO: 557 - RNA, 23 nt, Artificial Sequence
  Description of Artificial Sequence: Synthetic oligonucleotide
aagagcaaccucagcucuuuagu

SEQ ID NO: 558 - RNA, 23 nt, Artificial Sequence
  Description of Artificial Sequence: Synthetic oligonucleotide
aucugcacagagcaaccucagcu

SEQ ID NO: 559 - RNA, 23 nt, Artificial Sequence
  Description of Artificial Sequence: Synthetic oligonucleotide
acucguccucugcacagagcaac

SEQ ID NO: 560 - RNA, 23 nt, Artificial Sequence
  Description of Artificial Sequence: Synthetic oligonucleotide
augguuugcucguccucugcaca

SEQ ID NO: 561 - RNA, 23 nt, Artificial Sequence
  Description of Artificial Sequence: Synthetic oligonucleotide
acacguccugguuugcucguccu

SEQ ID NO: 562 - RNA, 23 nt, Artificial Sequence
  Description of Artificial Sequence: Synthetic oligonucleotide
acauccagcacguccugguuugc

SEQ ID NO: 563 - RNA, 23 nt, Artificial Sequence
  Description of Artificial Sequence: Synthetic oligonucleotide
aacgcugucauccagcacguccu

SEQ ID NO: 564 - RNA, 23 nt, Artificial Sequence
  Description of Artificial Sequence: Synthetic oligonucleotide
aagucugaacgcugucauccagc

SEQ ID NO: 565 - RNA, 23 nt, Artificial Sequence
  Description of Artificial Sequence: Synthetic oligonucleotide
aucugguaaaggagcauuccaua

SEQ ID NO: 566 - RNA, 23 nt, Artificial Sequence
  Description of Artificial Sequence: Synthetic oligonucleotide
acgguaauucugguaaaggagca

SEQ ID NO: 567 - RNA, 23 nt, Artificial Sequence
  Description of Artificial Sequence: Synthetic oligonucleotide
aagggauucgguaauucugguaa

SEQ ID NO: 568 - RNA, 23 nt, Artificial Sequence
  Description of Artificial Sequence: Synthetic oligonucleotide
aucugcugagggauucgguaauu

SEQ ID NO: 569 - RNA, 23 nt, Artificial Sequence
  Description of Artificial Sequence: Synthetic oligonucleotide
agccuuccucugcugagggauuc

SEQ ID NO: 570 - RNA, 23 nt, Artificial Sequence
  Description of Artificial Sequence: Synthetic oligonucleotide
acagcaaggccuuccucugcuga

SEQ ID NO: 571 - RNA, 23 nt, Artificial Sequence
  Description of Artificial Sequence: Synthetic oligonucleotide
agggaguucucggagacacugcg

SEQ ID NO: 572 - RNA, 23 nt, Artificial Sequence
  Description of Artificial Sequence: Synthetic oligonucleotide
agccacgagggaguucucggaga

SEQ ID NO: 573 - RNA, 23 nt, Artificial Sequence
  Description of Artificial Sequence: Synthetic oligonucleotide
aauccauugccacgagggaguuc

SEQ ID NO: 574 - RNA, 23 nt, Artificial Sequence
  Description of Artificial Sequence: Synthetic oligonucleotide
acgcguccuguuugcccagaaaa

SEQ ID NO: 575 - RNA, 23 nt, Artificial Sequence
  Description of Artificial Sequence: Synthetic oligonucleotide
aucuaucacgcguccuguuugcc

SEQ ID NO: 576 - RNA, 23 nt, Artificial Sequence
  Description of Artificial Sequence: Synthetic oligonucleotide
acggauucucuaucacgcguccu

SEQ ID NO: 577 - RNA, 23 nt, Artificial Sequence
  Description of Artificial Sequence: Synthetic oligonucleotide
accucugccggauucucuaucac

SEQ ID NO: 578 - RNA, 23 nt, Artificial Sequence
  Description of Artificial Sequence: Synthetic oligonucleotide
acucugggccucugccggauucu

SEQ ID NO: 579 - RNA, 23 nt, Artificial Sequence
  Description of Artificial Sequence: Synthetic oligonucleotide
auguucauccgugugcuucgcuu

SEQ ID NO: 580 - RNA, 23 nt, Artificial Sequence
  Description of Artificial Sequence: Synthetic oligonucleotide
accuaggauguucauccgugugc

SEQ ID NO: 581 - RNA, 23 nt, Artificial Sequence
  Description of Artificial Sequence: Synthetic oligonucleotide
auuggcuaccuaggauguucauc

SEQ ID NO: 582 - RNA, 23 nt, Artificial Sequence
  Description of Artificial Sequence: Synthetic oligonucleotide
acuuaggguagaaggguggaggg

SEQ ID NO: 583 - RNA, 23 nt, Artificial Sequence
  Description of Artificial Sequence: Synthetic oligonucleotide
acagugcuguguccugugaauca

SEQ ID NO: 584 - RNA, 23 nt, Artificial Sequence
  Description of Artificial Sequence: Synthetic oligonucleotide
agugaaaccagugcuguguccug

SEQ ID NO: 585 - RNA, 23 nt, Artificial Sequence
  Description of Artificial Sequence: Synthetic oligonucleotide
auccucccgugaaaccagugcug

SEQ ID NO: 586 - RNA, 23 nt, Artificial Sequence
  Description of Artificial Sequence: Synthetic oligonucleotide
acuggagauccucccgugaaacc

SEQ ID NO: 587 - RNA, 23 nt, Artificial Sequence
  Description of Artificial Sequence: Synthetic oligonucleotide
auuccucccuggagauccucccg

SEQ ID NO: 588 - RNA, 23 nt, Artificial Sequence
  Description of Artificial Sequence: Synthetic oligonucleotide
augugggauuccucccuggagau

SEQ ID NO: 589 - RNA, 23 nt, Artificial Sequence
  Description of Artificial Sequence: Synthetic oligonucleotide
aaugauccugugggauuccuccc

SEQ ID NO: 590 - RNA, 23 nt, Artificial Sequence
  Description of Artificial Sequence: Synthetic oligonucleotide
acuguuuaaugauccugugggau

SEQ ID NO: 591 - RNA, 23 nt, Artificial Sequence
  Description of Artificial Sequence: Synthetic oligonucleotide
agcccuugcuguuuaaugauccu

SEQ ID NO: 592 - RNA, 23 nt, Artificial Sequence
  Description of Artificial Sequence: Synthetic oligonucleotide
auccacgagcccuugcuguuuaa

SEQ ID NO: 593 - RNA, 23 nt, Homo sapiens
gacaagguggagcagacaccucg

SEQ ID NO: 594 - RNA, 23 nt, Homo sapiens
uggagcagacaccucgcagucaa

SEQ ID NO: 595 - RNA, 23 nt, Homo sapiens
gacaccucgcagucaacaagacc

SEQ ID NO: 596 - RNA, 23 nt, Homo sapiens
cgcagucaacaagacccggcagg

SEQ ID NO: 597 - RNA, 23 nt, Homo sapiens
aacaagacccggcaggaccagga

SEQ ID NO: 598 - RNA, 23 nt, Homo sapiens
cccgcacagucugaccgacuugc

SEQ ID NO: 599 - RNA, 23 nt, Homo sapiens
agucugaccgacuugcgaaucac

SEQ ID NO: 600 - RNA, 23 nt, Homo sapiens
aggaugauguggaccuggaagcc

SEQ ID NO: 601 - RNA, 23 nt, Homo sapiens
uguggaccuggaagcccugguga

SEQ ID NO: 602 - RNA, 23 nt, Homo sapiens
cuggaagcccuggugaacgauau

SEQ ID NO: 603 - RNA, 23 nt, Homo sapiens
cccuggugaacgauaugaaugca

SEQ ID NO: 604 - RNA, 23 nt, Homo sapiens
gaacgauaugaaugcaucccugg

SEQ ID NO: 605 - RNA, 23 nt, Homo sapiens
augaaugcaucccuggagagccu

SEQ ID NO: 606 - RNA, 23 nt, Homo sapiens
caucccuggagagccuguacucg

SEQ ID NO: 607 - RNA, 23 nt, Homo sapiens
gagagccuguacucggccugcag

SEQ ID NO: 608 - RNA, 23 nt, Homo sapiens
uguacucggccugcagcaugcag

SEQ ID NO: 609 - RNA, 23 nt, Homo sapiens
ggccugcagcaugcagucagaca

SEQ ID NO: 610 - RNA, 23 nt, Homo sapiens
agcaugcagucagacacggugcc

SEQ ID NO: 611 - RNA, 23 nt, Homo sapiens
cccuccugcagaauggccagcau

SEQ ID NO: 612 - RNA, 23 nt, Homo sapiens
cagaauggccagcaugcccgcag

SEQ ID NO: 613 - RNA, 23 nt, Homo sapiens
cuucaggcccuccucgguccauc

SEQ ID NO: 614 - RNA, 23 nt, Homo sapiens
cuccucgguccauccagccacag

SEQ ID NO: 615 - RNA, 23 nt, Homo sapiens
guccauccagccacagguguccc

SEQ ID NO: 616 - RNA, 23 nt, Homo sapiens
agcgcucccagccugugcacauc

SEQ ID NO: 617 - RNA, 23 nt, Homo sapiens
ccagccugugcacauccucgcug

SEQ ID NO: 618 - RNA, 23 nt, Homo sapiens
gcgccuucaggaggaagaccagc

SEQ ID NO: 619 - RNA, 23 nt, Homo sapiens
caggaggaagaccagcaguuuag

SEQ ID NO: 620 - RNA, 23 nt, Homo sapiens
aagaccagcaguuuagaaccuca

SEQ ID NO: 621 - RNA, 23 nt, Homo sapiens
gcaguuuagaaccucaucucugc

SEQ ID NO: 622 - RNA, 23 nt, Homo sapiens
agaaccucaucucugccggccau

SEQ ID NO: 623 - RNA, 23 nt, Homo sapiens
cccaauccuuuuccugaacucug

SEQ ID NO: 624 - RNA, 23 nt, Homo sapiens
cuuuuccugaacucuguggcccu

SEQ ID NO: 625 - RNA, 23 nt, Homo sapiens
ugaacucuguggcccugggagcc

SEQ ID NO: 626 - RNA, 23 nt, Homo sapiens
ccugugcucacgccggguucuuu

SEQ ID NO: 627 - RNA, 23 nt, Homo sapiens
ucacgccggguucuuuaccuccg

SEQ ID NO: 628 - RNA, 23 nt, Homo sapiens
ggguucuuuaccuccgagccagg

SEQ ID NO: 629 - RNA, 23 nt, Homo sapiens
gauguuaaagucuuuagugaaga

SEQ ID NO: 630 - RNA, 23 nt, Homo sapiens
aagucuuuagugaagaugggaca

SEQ ID NO: 631 - RNA, 23 nt, Homo sapiens
uagugaagaugggacaagcaaag

SEQ ID NO: 632 - RNA, 23 nt, Homo sapiens
gaugggacaagcaaaguggugga

SEQ ID NO: 633 - RNA, 23 nt, Homo sapiens
caagcaaagugguggagauucua

SEQ ID NO: 634 - RNA, 23 nt, Homo sapiens
agugguggagauucuagcagaca

SEQ ID NO: 635 - RNA, 23 nt, Homo sapiens
gagauucuagcagacaugacagc

SEQ ID NO: 636 - RNA, 23 nt, Homo sapiens
uagcagacaugacagccagagac

SEQ ID NO: 637 - RNA, 23 nt, Homo sapiens
caugacagccagagaccugugcc

SEQ ID NO: 638 - RNA, 23 nt, Homo sapiens
gccagagaccugugccaauugcu

SEQ ID NO: 639 - RNA, 23 nt, Homo sapiens
accugugccaauugcugguuuac

SEQ ID NO: 640 - RNA, 23 nt, Homo sapiens
ccaauugcugguuuacaaaaguc

SEQ ID NO: 641 - RNA, 23 nt, Homo sapiens
cugguuuacaaaagucacugugu

SEQ ID NO: 642 - RNA, 23 nt, Homo sapiens
acaaaagucacuguguggaugac

SEQ ID NO: 643 - RNA, 23 nt, Homo sapiens
ucacuguguggaugacaacagcu

SEQ ID NO: 644 - RNA, 23 nt, Homo sapiens
guggaugacaacagcuggacacu

SEQ ID NO: 645 - RNA, 23 nt, Homo sapiens
acaacagcuggacacuaguggag

SEQ ID NO: 646 - RNA, 23 nt, Homo sapiens
cuggacacuaguggagcaccacc

SEQ ID NO: 647 - RNA, 23 nt, Homo sapiens
uaguggagcaccacccgcaccua

SEQ ID NO: 648 - RNA, 23 nt, Homo sapiens
gcaccacccgcaccuaggauuag

SEQ ID NO: 649 - RNA, 23 nt, Homo sapiens
agaggugcuuggaagaccaugag

SEQ ID NO: 650 - RNA, 23 nt, Homo sapiens
cuuggaagaccaugagcuggugg

SEQ ID NO: 651 - RNA, 23 nt, Homo sapiens
gaccaugagcuggugguccaggu

SEQ ID NO: 652 - RNA, 23 nt, Homo sapiens
agcuggugguccagguggagagu

SEQ ID NO: 653 - RNA, 23 nt, Homo sapiens
gguccagguggagaguaccaugg

SEQ ID NO: 654 - RNA, 23 nt, Homo sapiens
guggagaguaccauggccaguga

SEQ ID NO: 655 - RNA, 23 nt, Homo sapiens
guaccauggccagugagaguaaa

SEQ ID NO: 656 - RNA, 23 nt, Homo sapiens
ggccagugagaguaaauuucuau

SEQ ID NO: 657 - RNA, 23 nt, Homo sapiens
gagaguaaauuucuauucaggaa

SEQ ID NO: 658 - RNA, 23 nt, Homo sapiens
auuucuauucaggaagaauuacg

SEQ ID NO: 659 - RNA, 23 nt, Homo sapiens
uucaggaagaauuacgcaaaaua

SEQ ID NO: 660 - RNA, 23 nt, Homo sapiens
agaauuacgcaaaauacgaguuc

SEQ ID NO: 661 - RNA, 23 nt, Homo sapiens
cgcaaaauacgaguucuuuaaaa

SEQ ID NO: 662 - RNA, 23 nt, Homo sapiens
aauuucuucccagaacagauggu

SEQ ID NO: 663 - RNA, 23 nt, Homo sapiens
ucccagaacagaugguuacuugg

SEQ ID NO: 664 - RNA, 23 nt, Homo sapiens
acagaugguuacuuggugccagc

SEQ ID NO: 665 - RNA, 23 nt, Homo sapiens
guuacuuggugccagcagucaaa

SEQ ID NO: 666 - RNA, 23 nt, Homo sapiens
ggugccagcagucaaauggcagu

SEQ ID NO: 667 - RNA, 23 nt, Homo sapiens
gcagucaaauggcagucaaaccc

SEQ ID NO: 668 - RNA, 23 nt, Homo sapiens
aauggcagucaaacccagcuuuu

SEQ ID NO: 669 - RNA, 23 nt, Homo sapiens
aauuuucugaacuccaguaguug

SEQ ID NO: 670 - RNA, 23 nt, Homo sapiens
ugaacuccaguaguuguccugaa

SEQ ID NO: 671 - RNA, 23 nt, Homo sapiens
caguaguuguccugaaauucaag

SEQ ID NO: 672 - RNA, 23 nt, Homo sapiens
uuuugcaugugaaagagcuggga

SEQ ID NO: 673 - RNA, 23 nt, Homo sapiens
ugugaaagagcugggaaagaaau

SEQ ID NO: 674 - RNA, 23 nt, Homo sapiens
gagcugggaaagaaaucauggaa

SEQ ID NO: 675 - RNA, 23 nt, Homo sapiens
aaaagcuguauguguguuugcgg

SEQ ID NO: 676 - RNA, 23 nt, Homo sapiens
guauguguguuugcggagaucug

SEQ ID NO: 677 - RNA, 23 nt, Homo sapiens
uguuugcggagaucuggccuuua

SEQ ID NO: 678 - RNA, 23 nt, Homo sapiens
ggagaucuggccuuuauugcucc

SEQ ID NO: 679 - RNA, 23 nt, Homo sapiens
uggccuuuauugcuccaccaagg

SEQ ID NO: 680 - RNA, 23 nt, Homo sapiens
uauugcuccaccaagggaacuuc

SEQ ID NO: 681 - RNA, 23 nt, Homo sapiens
gaacccagacaccugcagcugcu

SEQ ID NO: 682 - RNA, 23 nt, Homo sapiens
uggccgaccuggaggacagcaac

SEQ ID NO: 683 - RNA, 23 nt, Homo sapiens
ccuggaggacagcaacaucuucu

SEQ ID NO: 684 - RNA, 23 nt, Homo sapiens
gacagcaacaucuucucccugau

SEQ ID NO: 685 - RNA, 23 nt, Homo sapiens
acaucuucucccugaucgcuggc

SEQ ID NO: 686 - RNA, 23 nt, Homo sapiens
cucccugaucgcuggcaggaagc

SEQ ID NO: 687 - RNA, 23 nt, Homo sapiens
aucgcuggcaggaagcaguacaa

SEQ ID NO: 688 - RNA, 23 nt, Homo sapiens
ccuacagaccacgggcucugcau

SEQ ID NO: 689 - RNA, 23 nt, Homo sapiens
ccaaacaaagucaggaaugaaac

SEQ ID NO: 690 - RNA, 23 nt, Homo sapiens
aagucaggaaugaaacuaaagag

SEQ ID NO: 691 - RNA, 23 nt, Homo sapiens
gaaugaaacuaaagagcugaggu

SEQ ID NO: 692 - RNA, 23 nt, Homo sapiens
acuaaagagcugagguugcucug

SEQ ID NO: 693 - RNA, 23 nt, Homo sapiens
agcugagguugcucugugcagag

SEQ ID NO: 694 - RNA, 23 nt, Homo sapiens
guugcucugugcagaggacgagc

SEQ ID NO: 695 - RNA, 23 nt, Homo sapiens
ugugcagaggacgagcaaaccag

SEQ ID NO: 696 - RNA, 23 nt, Homo sapiens
aggacgagcaaaccaggacgugc

SEQ ID NO: 697 - RNA, 23 nt, Homo sapiens
gcaaaccaggacgugcuggauga

SEQ ID NO: 698 - RNA, 23 nt, Homo sapiens
aggacgugcuggaugacagcguu

SEQ ID NO: 699 - RNA, 23 nt, Homo sapiens
gcuggaugacagcguucagacuc

SEQ ID NO: 700 - RNA, 23 nt, Homo sapiens
uauggaaugcuccuuuaccagaa

SEQ ID NO: 701 - RNA, 23 nt, Homo sapiens
ugcuccuuuaccagaauuaccga

SEQ ID NO: 702 - RNA, 23 nt, Homo sapiens
uuaccagaauuaccgaaucccuc

SEQ ID NO: 703 - RNA, 23 nt, Homo sapiens
aauuaccgaaucccucagcagag

SEQ ID NO: 704 - RNA, 23 nt, Homo sapiens
gaaucccucagcagaggaaggcc

SEQ ID NO: 705 - RNA, 23 nt, Homo sapiens
ucagcagaggaaggccuugcugu

SEQ ID NO: 706 - RNA, 23 nt, Homo sapiens
cgcagugucuccgagaacucccu

SEQ ID NO: 707 - RNA, 23 nt, Homo sapiens
ucuccgagaacucccucguggca

SEQ ID NO: 708 - RNA, 23 nt, Homo sapiens
gaacucccucguggcaauggauu

SEQ ID NO: 709 - RNA, 23 nt, Homo sapiens
uuuucugggcaaacaggacgcgu

SEQ ID NO: 710 - RNA, 23 nt, Homo sapiens
ggcaaacaggacgcgugauagag

SEQ ID NO: 711 - RNA, 23 nt, Homo sapiens
aggacgcgugauagagaauccgg

SEQ ID NO: 712 - RNA, 23 nt, Homo sapiens
gugauagagaauccggcagaggc

SEQ ID NO: 713 - RNA, 23 nt, Homo sapiens
agaauccggcagaggcccagagc

SEQ ID NO: 714 - RNA, 23 nt, Homo sapiens
aagcgaagcacacggaugaacau

SEQ ID NO: 715 - RNA, 23 nt, Homo sapiens
gcacacggaugaacauccuaggu

SEQ ID NO: 716 - RNA, 23 nt, Homo sapiens
gaugaacauccuagguagccaaa

SEQ ID NO: 717 - RNA, 23 nt, Homo sapiens
cccuccacccuucuacccuaagu

SEQ ID NO: 718 - RNA, 23 nt, Homo sapiens
ugauucacaggacacagcacugg

SEQ ID NO: 719 - RNA, 23 nt, Homo sapiens
caggacacagcacugguuucacg

SEQ ID NO: 720 - RNA, 23 nt, Homo sapiens
cagcacugguuucacgggaggau

SEQ ID NO: 721 - RNA, 23 nt, Homo sapiens
gguuucacgggaggaucuccagg

SEQ ID NO: 722 - RNA, 23 nt, Homo sapiens
cgggaggaucuccagggaggaau

SEQ ID NO: 723 - RNA, 23 nt, Homo sapiens
aucuccagggaggaaucccacag

SEQ ID NO: 724 - RNA, 23 nt, Homo sapiens
gggaggaaucccacaggaucauu

SEQ ID NO: 725 - RNA, 23 nt, Homo sapiens
aucccacaggaucauuaaacagc

SEQ ID NO: 726 - RNA, 23 nt, Homo sapiens
aggaucauuaaacagcaagggcu

SEQ ID NO: 727 - RNA, 23 nt, Homo sapiens
uuaaacagcaagggcucguggau

SEQ ID NO: 728 - RNA, 21 nt, Artificial Sequence
  Description of Artificial Sequence: Synthetic oligonucleotide
gccggcgacaaugaccacuuu

SEQ ID NO: 729 - RNA, 21 nt, Artificial Sequence
  Description of Artificial Sequence: Synthetic oligonucleotide
ugaccacuucccugcaagauu

SEQ ID NO: 730 - RNA, 21 nt, Artificial Sequence
  Description of Artificial Sequence: Synthetic oligonucleotide
gcugugcugcagacaggagau

SEQ ID NO: 731 - RNA, 21 nt, Artificial Sequence
  Description of Artificial Sequence: Synthetic oligonucleotide
aagaaagaucuugauguuccu

SEQ ID NO: 732 - RNA, 21 nt, Artificial Sequence
  Description of Artificial Sequence: Synthetic oligonucleotide
ugauguuccggaaaugccauu

SEQ ID NO: 733 - RNA, 21 nt, Artificial Sequence
  Description of Artificial Sequence: Synthetic oligonucleotide
aaaugccaucuauuccaaacu

SEQ ID NO: 734 - RNA, 21 nt, Artificial Sequence
  Description of Artificial Sequence: Synthetic oligonucleotide
auuccaaacccuuuuccugau

SEQ ID NO: 735 - RNA, 21 nt, Artificial Sequence
  Description of Artificial Sequence: Synthetic oligonucleotide
uuuuccugagcuaugcuguuu

SEQ ID NO: 736 - RNA, 21 nt, Artificial Sequence
  Description of Artificial Sequence: Synthetic oligonucleotide
uaugcuguucuccauuuacau

SEQ ID NO: 737 - RNA, 21 nt, Artificial Sequence
  Description of Artificial Sequence: Synthetic oligonucleotide
ccauuuacaucuguguugucu

SEQ ID NO: 738 - RNA, 21 nt, Artificial Sequence
  Description of Artificial Sequence: Synthetic oligonucleotide
uguguugucagcagaccuauu

SEQ ID NO: 739 - RNA, 21 nt, Artificial Sequence
  Description of Artificial Sequence: Synthetic oligonucleotide
cagaccuauuucccaaagcau

SEQ ID NO: 740 - RNA, 21 nt, Artificial Sequence
  Description of Artificial Sequence: Synthetic oligonucleotide
cccaaagcaaauucaaggaau

SEQ ID NO: 741 - RNA, 21 nt, Artificial Sequence
  Description of Artificial Sequence: Synthetic oligonucleotide
aacaggugauuaaaguauacu

SEQ ID NO: 742 - RNA, 21 nt, Artificial Sequence
  Description of Artificial Sequence: Synthetic oligonucleotide
aaaguauacagugaagaugau

SEQ ID NO: 743 - RNA, 21 nt, Artificial Sequence
  Description of Artificial Sequence: Synthetic oligonucleotide
ugaagaugaaaccagcagggu

SEQ ID NO: 744 - RNA, 21 nt, Artificial Sequence
  Description of Artificial Sequence: Synthetic oligonucleotide
ccagcagggcuuuagauguau

SEQ ID NO: 745 - RNA, 21 nt, Artificial Sequence
  Description of Artificial Sequence: Synthetic oligonucleotide
uuagauguacccagugacauu

SEQ ID NO: 746 - RNA, 21 nt, Artificial Sequence
  Description of Artificial Sequence: Synthetic oligonucleotide
cagugacauaacggcucgagu

SEQ ID NO: 747 - RNA, 21 nt, Artificial Sequence
  Description of Artificial Sequence: Synthetic oligonucleotide
cggcucgagauguuugucagu

SEQ ID NO: 748 - RNA, 21 nt, Artificial Sequence
  Description of Artificial Sequence: Synthetic oligonucleotide
guuugucagcuguugauccuu

SEQ ID NO: 749 - RNA, 21 nt, Artificial Sequence
  Description of Artificial Sequence: Synthetic oligonucleotide
guugauccugaagaaucauuu

SEQ ID NO: 750 - RNA, 21 nt, Artificial Sequence
  Description of Artificial Sequence: Synthetic oligonucleotide
agaaucauuacauugaugacu

SEQ ID NO: 751 - RNA, 21 nt, Artificial Sequence
  Description of Artificial Sequence: Synthetic oligonucleotide
auugaugaccacagcuggacu

SEQ ID NO: 752 - RNA, 21 nt, Artificial Sequence
  Description of Artificial Sequence: Synthetic oligonucleotide
cagcuggacccuuuuugagcu

SEQ ID NO: 753 - RNA, 21 nt, Artificial Sequence
  Description of Artificial Sequence: Synthetic oligonucleotide
uuuuugagcaccugccucacu

SEQ ID NO: 754 - RNA, 21 nt, Artificial Sequence
  Description of Artificial Sequence: Synthetic oligonucleotide
cugccucacauagguguagau

SEQ ID NO: 755 - RNA, 21 nt, Artificial Sequence
  Description of Artificial Sequence: Synthetic oligonucleotide
agguguagaaagaacaauagu

SEQ ID NO: 756 - RNA, 21 nt, Artificial Sequence
  Description of Artificial Sequence: Synthetic oligonucleotide
gaacaauagaagaccacgaau

SEQ ID NO: 757 - RNA, 21 nt, Artificial Sequence
  Description of Artificial Sequence: Synthetic oligonucleotide
gaccacgaacuggugauugau

SEQ ID NO: 758 - RNA, 21 nt, Artificial Sequence
  Description of Artificial Sequence: Synthetic oligonucleotide
ggugauugaagugcuauccau

SEQ ID NO: 759 - RNA, 21 nt, Artificial Sequence
  Description of Artificial Sequence: Synthetic oligonucleotide
gauagaagaagaaaacaaacu

SEQ ID NO: 760 - RNA, 21 nt, Artificial Sequence
  Description of Artificial Sequence: Synthetic oligonucleotide
auuaugccaaauaugaguucu

SEQ ID NO: 761 - RNA, 21 nt, Artificial Sequence
  Description of Artificial Sequence: Synthetic oligonucleotide
aacccaauguauuuuuuuccu

SEQ ID NO: 762 - RNA, 21 nt, Artificial Sequence
  Description of Artificial Sequence: Synthetic oligonucleotide
uuuuuuuccagagcauauggu

SEQ ID NO: 763 - RNA, 21 nt, Artificial Sequence
  Description of Artificial Sequence: Synthetic oligonucleotide
agcauaugguaucuuuugcau

SEQ ID NO: 764 - RNA, 21 nt, Artificial Sequence
  Description of Artificial Sequence: Synthetic oligonucleotide
ucuuuugcaacugaaaccaau

SEQ ID NO: 765 - RNA, 21 nt, Artificial Sequence
  Description of Artificial Sequence: Synthetic oligonucleotide
ugaaaccaauggugaaauauu

SEQ ID NO: 766 - RNA, 21 nt, Artificial Sequence
  Description of Artificial Sequence: Synthetic oligonucleotide
cacacagauuuugcagauguu

SEQ ID NO: 767 - RNA, 21 nt, Artificial Sequence
  Description of Artificial Sequence: Synthetic oligonucleotide
ugcagauguuucugaguucau

SEQ ID NO: 768 - RNA, 21 nt, Artificial Sequence
  Description of Artificial Sequence: Synthetic oligonucleotide
cugaguucaagcacauauccu

SEQ ID NO: 769 - RNA, 21 nt, Artificial Sequence
  Description of Artificial Sequence: Synthetic oligonucleotide
cacauauccugaaauucaugu

SEQ ID NO: 770 - RNA, 21 nt, Artificial Sequence
  Description of Artificial Sequence: Synthetic oligonucleotide
aaauucaugguuucuuacauu

SEQ ID NO: 771 - RNA, 21 nt, Artificial Sequence
  Description of Artificial Sequence: Synthetic oligonucleotide
uucuuacaugcgaaagaacau

SEQ ID NO: 772 - RNA, 21 nt, Artificial Sequence
  Description of Artificial Sequence: Synthetic oligonucleotide
gaaagaacagggaaagaaguu

SEQ ID NO: 773 - RNA, 21 nt, Artificial Sequence
  Description of Artificial Sequence: Synthetic oligonucleotide
cuuuuuucuaagaagaucugu

SEQ ID NO: 774 - RNA, 21 nt, Artificial Sequence
  Description of Artificial Sequence: Synthetic oligonucleotide
agaucugguuuauauuuuucu

SEQ ID NO: 775 - RNA, 21 nt, Artificial Sequence
  Description of Artificial Sequence: Synthetic oligonucleotide
uuuucuacuaaaggaacaucu

SEQ ID NO: 776 - RNA, 21 nt, Artificial Sequence
  Description of Artificial Sequence: Synthetic oligonucleotide
aggaacaucaaaggaaccgcu

SEQ ID NO: 777 - RNA, 21 nt, Artificial Sequence
  Description of Artificial Sequence: Synthetic oligonucleotide
aggaaccgcggcauuugcagu

SEQ ID NO: 778 - RNA, 21 nt, Artificial Sequence
  Description of Artificial Sequence: Synthetic oligonucleotide
cauuugcaguuuuucagcgau

SEQ ID NO: 779 - RNA, 21 nt, Artificial Sequence
  Description of Artificial Sequence: Synthetic oligonucleotide
uuucagcgaauuuggcaauau

SEQ ID NO: 780 - RNA, 21 nt, Artificial Sequence
  Description of Artificial Sequence: Synthetic oligonucleotide
uggcaauagugauauuuaugu

SEQ ID NO: 781 - RNA, 21 nt, Artificial Sequence
  Description of Artificial Sequence: Synthetic oligonucleotide
auauuuaugugucacuggcau

SEQ ID NO: 782 - RNA, 21 nt, Artificial Sequence
  Description of Artificial Sequence: Synthetic oligonucleotide
aacauggagcaccgacuaacu

SEQ ID NO: 783 - RNA, 21 nt, Artificial Sequence
  Description of Artificial Sequence: Synthetic oligonucleotide
ccgacuaacuauggauucugu

SEQ ID NO: 784 - RNA, 21 nt, Artificial Sequence
  Description of Artificial Sequence: Synthetic oligonucleotide
uggauucugcuuuaagccuau

SEQ ID NO: 785 - RNA, 21 nt, Artificial Sequence
  Description of Artificial Sequence: Synthetic oligonucleotide
uuaagccuaacaaagcgggau

SEQ ID NO: 786 - RNA, 21 nt, Artificial Sequence
  Description of Artificial Sequence: Synthetic oligonucleotide
cgagaccugaaaaugcucugu

SEQ ID NO: 787 - RNA, 21 nt, Artificial Sequence
  Description of Artificial Sequence: Synthetic oligonucleotide
aaugcucugugcagaagaagu

SEQ ID NO: 788 - RNA, 21 nt, Artificial Sequence
  Description of Artificial Sequence: Synthetic oligonucleotide
cagaagaagagcagaguaggu

SEQ ID NO: 789 - RNA, 21 nt, Artificial Sequence
  Description of Artificial Sequence: Synthetic oligonucleotide
cagaguaggacgugcuggguu

SEQ ID NO: 790 - RNA, 21 nt, Artificial Sequence
  Description of Artificial Sequence: Synthetic oligonucleotide
gugcugggugaccgcgauuau

SEQ ID NO: 791 - RNA, 21 nt, Artificial Sequence
  Description of Artificial Sequence: Synthetic oligonucleotide
ccgcgauuagauugcuuaagu

SEQ ID NO: 792 - RNA, 21 nt, Artificial Sequence
  Description of Artificial Sequence: Synthetic oligonucleotide
uugcuuaaguauggcaugcau

SEQ ID NO: 793 - RNA, 21 nt, Artificial Sequence
  Description of Artificial Sequence: Synthetic oligonucleotide
uggcaugcagcuguaccagau

SEQ ID NO: 794 - RNA, 21 nt, Artificial Sequence
  Description of Artificial Sequence: Synthetic oligonucleotide
uguaccagaauuauaugcauu

SEQ ID NO: 795 - RNA, 21 nt, Artificial Sequence
  Description of Artificial Sequence: Synthetic oligonucleotide
uauaugcauccauaucaaggu

SEQ ID NO: 796 - RNA, 21 nt, Artificial Sequence
  Description of Artificial Sequence: Synthetic oligonucleotide
auaucaagguagaaguggcuu

SEQ ID NO: 797 - RNA, 21 nt, Artificial Sequence
  Description of Artificial Sequence: Synthetic oligonucleotide
gaaguggcugcaguucacagu

SEQ ID NO: 798 - RNA, 21 nt, Artificial Sequence
  Description of Artificial Sequence: Synthetic oligonucleotide
aguucacagagcauaucaccu

SEQ ID NO: 799 - RNA, 21 nt, Artificial Sequence
  Description of Artificial Sequence: Synthetic oligonucleotide
cauaucaccuaugagaaguau

SEQ ID NO: 800 - RNA, 21 nt, Artificial Sequence
  Description of Artificial Sequence: Synthetic oligonucleotide
ugagaaguauaucagagaauu

SEQ ID NO: 801 - RNA, 21 nt, Artificial Sequence
  Description of Artificial Sequence: Synthetic oligonucleotide
ucagagaauucccugguagcu

SEQ ID NO: 802 - RNA, 21 nt, Artificial Sequence
  Description of Artificial Sequence: Synthetic oligonucleotide
ccugguagcaauggacuucuu

SEQ ID NO: 803 - RNA, 21 nt, Artificial Sequence
  Description of Artificial Sequence: Synthetic oligonucleotide
uggacuucucaggccagaaau

SEQ ID NO: 804 - RNA, 21 nt, Artificial Sequence
  Description of Artificial Sequence: Synthetic oligonucleotide
ggccagaaaagcagaguuauu

SEQ ID NO: 805 - RNA, 21 nt, Artificial Sequence
  Description of Artificial Sequence: Synthetic oligonucleotide
cagaguuauagaaaaucccau

SEQ ID NO: 806 - RNA, 21 nt, Artificial Sequence
  Description of Artificial Sequence: Synthetic oligonucleotide
aaaaucccacugaagcccuuu

SEQ ID NO: 807 - RNA, 21 nt, Artificial Sequence
  Description of Artificial Sequence: Synthetic oligonucleotide
gaagcccuuucaguugcgguu

SEQ ID NO: 808 - RNA, 21 nt, Artificial Sequence
  Description of Artificial Sequence: Synthetic oligonucleotide
aguugcgguugaagaaggacu

SEQ ID NO: 809 - RNA, 21 nt, Artificial Sequence
  Description of Artificial Sequence: Synthetic oligonucleotide
aagaaggacucgcuuggaggu

SEQ ID NO: 810 - RNA, 21 nt, Artificial Sequence
  Description of Artificial Sequence: Synthetic oligonucleotide
aaggauguuuacgccugggcu

SEQ ID NO: 811 - RNA, 21 nt, Artificial Sequence
  Description of Artificial Sequence: Synthetic oligonucleotide
cgccugggcacucacgguagu

SEQ ID NO: 812 - RNA, 21 nt, Artificial Sequence
  Description of Artificial Sequence: Synthetic oligonucleotide
cacugccucuucacagagcuu

SEQ ID NO: 813 - RNA, 21 nt, Artificial Sequence
  Description of Artificial Sequence: Synthetic oligonucleotide
cacagagcucugccacaaacu

SEQ ID NO: 814 - RNA, 21 nt, Artificial Sequence
  Description of Artificial Sequence: Synthetic oligonucleotide
gccacaaacauggcuauccau

SEQ ID NO: 815 - RNA, 21 nt, Artificial Sequence
  Description of Artificial Sequence: Synthetic oligonucleotide
ggcuauccaccggucccagcu

SEQ ID NO: 816 - RNA, 21 nt, Artificial Sequence
  Description of Artificial Sequence: Synthetic oligonucleotide
ggucccagccaugguuucacu

SEQ ID NO: 817 - RNA, 21 nt, Artificial Sequence
  Description of Artificial Sequence: Synthetic oligonucleotide
ugguuucaccacaaaauuucu

SEQ ID NO: 818 - RNA, 21 nt, Artificial Sequence
  Description of Artificial Sequence: Synthetic oligonucleotide
caaaauuucuagagaugaggu

SEQ ID NO: 819 - RNA, 21 nt, Artificial Sequence
  Description of Artificial Sequence: Synthetic oligonucleotide
gagaugaggcucagcgauugu

SEQ ID NO: 820 - RNA, 21 nt, Artificial Sequence
  Description of Artificial Sequence: Synthetic oligonucleotide
cagcgauugauuauucagcau

SEQ ID NO: 821 - RNA, 21 nt, Artificial Sequence
  Description of Artificial Sequence: Synthetic oligonucleotide
uauucagcaaggacuuguggu

SEQ ID NO: 822 - RNA, 21 nt, Artificial Sequence
  Description of Artificial Sequence: Synthetic oligonucleotide
gacuuguggauggaguuuucu

SEQ ID NO: 823 - RNA, 21 nt, Artificial Sequence
  Description of Artificial Sequence: Synthetic oligonucleotide
ggaguuuucuugguacgggau

SEQ ID NO: 824 - RNA, 21 nt, Artificial Sequence
  Description of Artificial Sequence: Synthetic oligonucleotide
gguacgggauagucagaguau

SEQ ID NO: 825 - RNA, 21 nt, Artificial Sequence
  Description of Artificial Sequence: Synthetic oligonucleotide
caaaacuuucguacugucaau

SEQ ID NO: 826 - RNA, 21 nt, Artificial Sequence
  Description of Artificial Sequence: Synthetic oligonucleotide
uacugucaaugagucauggau

SEQ ID NO: 827 - RNA, 21 nt, Artificial Sequence
  Description of Artificial Sequence: Synthetic oligonucleotide
aagcacuuucaaauuauaccu

SEQ ID NO: 828 - RNA, 21 nt, Artificial Sequence
  Description of Artificial Sequence: Synthetic oligonucleotide
aauuauaccaguagaagaugu

SEQ ID NO: 829 - RNA, 21 nt, Artificial Sequence
  Description of Artificial Sequence: Synthetic oligonucleotide
uagaagaugacggugaaaugu

SEQ ID NO: 830 - RNA, 21 nt, Artificial Sequence
  Description of Artificial Sequence: Synthetic oligonucleotide
ggugaaauguuccacacacuu

SEQ ID NO: 831 - RNA, 21 nt, Artificial Sequence
  Description of Artificial Sequence: Synthetic oligonucleotide
ccacacacuggaugauggccu

SEQ ID NO: 832 - RNA, 21 nt, Artificial Sequence
  Description of Artificial Sequence: Synthetic oligonucleotide
augauggccacacaagauuuu

SEQ ID NO: 833 - RNA, 21 nt, Artificial Sequence
  Description of Artificial Sequence: Synthetic oligonucleotide
acaagauuuacagaucuaauu

SEQ ID NO: 834 - RNA, 21 nt, Artificial Sequence
  Description of Artificial Sequence: Synthetic oligonucleotide
agaucuaauacagcugguggu

SEQ ID NO: 835 - RNA, 21 nt, Artificial Sequence
  Description of Artificial Sequence: Synthetic oligonucleotide
agcugguggaguucuaucaau

SEQ ID NO: 836 - RNA, 21 nt, Artificial Sequence
  Description of Artificial Sequence: Synthetic oligonucleotide
uucuaucaacucaauaagggu

SEQ ID NO: 837 - RNA, 21 nt, Artificial Sequence
  Description of Artificial Sequence: Synthetic oligonucleotide
caauaagggcguucuuccuuu

SEQ ID NO: 838 - RNA, 21 nt, Artificial Sequence
  Description of Artificial Sequence: Synthetic oligonucleotide
uucuuccuugcaaguugaaau

SEQ ID NO: 839 - RNA, 21 nt, Artificial Sequence
  Description of Artificial Sequence: Synthetic oligonucleotide
aaguugaaacauuauugugcu

SEQ ID NO: 840 - RNA, 21 nt, Artificial Sequence
  Description of Artificial Sequence: Synthetic oligonucleotide
uuauugugcuaggauugcucu

SEQ ID NO: 841 - RNA, 21 nt, Artificial Sequence
  Description of Artificial Sequence: Synthetic oligonucleotide
ggauugcucucuagacaagcu

SEQ ID NO: 842 - RNA, 21 nt, Artificial Sequence
  Description of Artificial Sequence: Synthetic oligonucleotide
uagacaagccagaagugacuu

SEQ ID NO: 843 - RNA, 21 nt, Artificial Sequence
  Description of Artificial Sequence: Synthetic oligonucleotide
gaagugacuuauuaaacuauu

SEQ ID NO: 844 - RNA, 21 nt, Artificial Sequence
  Description of Artificial Sequence: Synthetic oligonucleotide
uaaacuauugaaggaaaaggu

SEQ ID NO: 845 - RNA, 21 nt, Artificial Sequence
  Description of Artificial Sequence: Synthetic oligonucleotide
uaaaagaccauaaauaagggu

SEQ ID NO: 846 - RNA, 21 nt, Artificial Sequence
  Description of Artificial Sequence: Synthetic oligonucleotide
aaauaagggcgaaaacauuau

SEQ ID NO: 847 - RNA, 21 nt, Artificial Sequence
  Description of Artificial Sequence: Synthetic oligonucleotide
aaaacauuaccaugugaaaau

SEQ ID NO: 848 - RNA, 21 nt, Artificial Sequence
  Description of Artificial Sequence: Synthetic oligonucleotide
augugaaaagaauguauuucu

SEQ ID NO: 849 - RNA, 21 nt, Artificial Sequence
  Description of Artificial Sequence: Synthetic oligonucleotide
auguauuucaccugcaaguuu

SEQ ID NO: 850 - RNA, 21 nt, Artificial Sequence
  Description of Artificial Sequence: Synthetic oligonucleotide
aauaguuugugcauugcaaau

SEQ ID NO: 851 - RNA, 21 nt, Artificial Sequence
  Description of Artificial Sequence: Synthetic oligonucleotide
cauugcaaauaagcaaagacu

SEQ ID NO: 852 - RNA, 21 nt, Artificial Sequence
  Description of Artificial Sequence: Synthetic oligonucleotide
agcaaagacuuggauugacuu

SEQ ID NO: 853 - RNA, 21 nt, Artificial Sequence
  Description of Artificial Sequence: Synthetic oligonucleotide
ggauugacuuuacauucaucu

SEQ ID NO: 854 - RNA, 21 nt, Artificial Sequence
  Description of Artificial Sequence: Synthetic oligonucleotide
aaugacuugguguguucuugu

SEQ ID NO: 855 - RNA, 21 nt, Artificial Sequence
  Description of Artificial Sequence: Synthetic oligonucleotide
guguucuugugugauuuuuau

SEQ ID NO: 856 - RNA, 21 nt, Artificial Sequence
  Description of Artificial Sequence: Synthetic oligonucleotide
gcauauuuaaaacaugucucu

SEQ ID NO: 857 - RNA, 21 nt, Artificial Sequence
  Description of Artificial Sequence: Synthetic oligonucleotide
acaugucucccuuauuuaccu

SEQ ID NO: 858 - RNA, 21 nt, Artificial Sequence
  Description of Artificial Sequence: Synthetic oligonucleotide
uuauuuaccauauagcaacau

SEQ ID NO: 859 - RNA, 21 nt, Artificial Sequence
  Description of Artificial Sequence: Synthetic oligonucleotide
auagcaacaucagaauucugu

SEQ ID NO: 860 - RNA, 21 nt, Artificial Sequence
  Description of Artificial Sequence: Synthetic oligonucleotide
agaauucugaaacacaaaauu

SEQ ID NO: 861 - RNA, 21 nt, Artificial Sequence
  Description of Artificial Sequence: Synthetic oligonucleotide
uaugaaauaaauugggagucu

SEQ ID NO: 862 - RNA, 21 nt, Artificial Sequence
  Description of Artificial Sequence: Synthetic oligonucleotide
uugggagucaggaauaauuau

SEQ ID NO: 863 - RNA, 23 nt, Artificial Sequence
  Description of Artificial Sequence: Synthetic oligonucleotide
aaaguggucauugucgccggccg

SEQ ID NO: 864 - RNA, 23 nt, Artificial Sequence
  Description of Artificial Sequence: Synthetic oligonucleotide
aaucuugcagggaaguggucauu

SEQ ID NO: 865 - RNA, 23 nt, Artificial Sequence
  Description of Artificial Sequence: Synthetic oligonucleotide
aucuccugucugcagcacagccg

SEQ ID NO: 866 - RNA, 23 nt, Artificial Sequence
  Description of Artificial Sequence: Synthetic oligonucleotide
aggaacaucaagaucuuucuuuu

SEQ ID NO: 867 - RNA, 23 nt, Artificial Sequence
  Description of Artificial Sequence: Synthetic oligonucleotide
aauggcauuuccggaacaucaag

SEQ ID NO: 868 - RNA, 23 nt, Artificial Sequence
  Description of Artificial Sequence: Synthetic oligonucleotide
aguuuggaauagauggcauuucc

SEQ ID NO: 869 - RNA, 23 nt, Artificial Sequence
  Description of Artificial Sequence: Synthetic oligonucleotide
aucaggaaaaggguuuggaauag

SEQ ID NO: 870 - RNA, 23 nt, Artificial Sequence
  Description of Artificial Sequence: Synthetic oligonucleotide
aaacagcauagcucaggaaaagg

SEQ ID NO: 871 - RNA, 23 nt, Artificial Sequence
  Description of Artificial Sequence: Synthetic oligonucleotide
auguaaauggagaacagcauagc

SEQ ID NO: 872 - RNA, 23 nt, Artificial Sequence
  Description of Artificial Sequence: Synthetic oligonucleotide
agacaacacagauguaaauggag

SEQ ID NO: 873 - RNA, 23 nt, Artificial Sequence
  Description of Artificial Sequence: Synthetic oligonucleotide
aauaggucugcugacaacacaga

SEQ ID NO: 874 - RNA, 23 nt, Artificial Sequence
  Description of Artificial Sequence: Synthetic oligonucleotide
augcuuugggaaauaggucugcu

SEQ ID NO: 875 - RNA, 23 nt, Artificial Sequence
  Description of Artificial Sequence: Synthetic oligonucleotide
auuccuugaauuugcuuugggaa

SEQ ID NO: 876 - RNA, 23 nt, Artificial Sequence
  Description of Artificial Sequence: Synthetic oligonucleotide
aguauacuuuaaucaccuguuuu

SEQ ID NO: 877 - RNA, 23 nt, Artificial Sequence
  Description of Artificial Sequence: Synthetic oligonucleotide
aucaucuucacuguauacuuuaa

SEQ ID NO: 878 - RNA, 23 nt, Artificial Sequence
  Description of Artificial Sequence: Synthetic oligonucleotide
acccugcugguuucaucuucacu

SEQ ID NO: 879 - RNA, 23 nt, Artificial Sequence
  Description of Artificial Sequence: Synthetic oligonucleotide
auacaucuaaagcccugcugguu

SEQ ID NO: 880 - RNA, 23 nt, Artificial Sequence
  Description of Artificial Sequence: Synthetic oligonucleotide
aaugucacuggguacaucuaaag

SEQ ID NO: 881 - RNA, 23 nt, Artificial Sequence
  Description of Artificial Sequence: Synthetic oligonucleotide
acucgagccguuaugucacuggg

SEQ ID NO: 882 - RNA, 23 nt, Artificial Sequence
  Description of Artificial Sequence: Synthetic oligonucleotide
acugacaaacaucucgagccguu

SEQ ID NO: 883 - RNA, 23 nt, Artificial Sequence
  Description of Artificial Sequence: Synthetic oligonucleotide
aaggaucaacagcugacaaacau

SEQ ID NO: 884 - RNA, 23 nt, Artificial Sequence
  Description of Artificial Sequence: Synthetic oligonucleotide
aaaugauucuucaggaucaacag

SEQ ID NO: 885 - RNA, 23 nt, Artificial Sequence
  Description of Artificial Sequence: Synthetic oligonucleotide
agucaucaauguaaugauucuuc

SEQ ID NO: 886 - RNA, 23 nt, Artificial Sequence
  Description of Artificial Sequence: Synthetic oligonucleotide
aguccagcuguggucaucaaugu

SEQ ID NO: 887 - RNA, 23 nt, Artificial Sequence
  Description of Artificial Sequence: Synthetic oligonucleotide
agcucaaaaaggguccagcugug

SEQ ID NO: 888 - RNA, 23 nt, Artificial Sequence
  Description of Artificial Sequence: Synthetic oligonucleotide
agugaggcaggugcucaaaaagg

SEQ ID NO: 889 - RNA, 23 nt, Artificial Sequence
  Description of Artificial Sequence: Synthetic oligonucleotide
aucuacaccuaugugaggcaggu

SEQ ID NO: 890 - RNA, 23 nt, Artificial Sequence
  Description of Artificial Sequence: Synthetic oligonucleotide
acuauuguucuuucuacaccuau

SEQ ID NO: 891 - RNA, 23 nt, Artificial Sequence
  Description of Artificial Sequence: Synthetic oligonucleotide
auucguggucuucuauuguucuu

SEQ ID NO: 892 - RNA, 23 nt, Artificial Sequence
  Description of Artificial Sequence: Synthetic oligonucleotide
aucaaucaccaguucguggucuu

SEQ ID NO: 893 - RNA, 23 nt, Artificial Sequence
  Description of Artificial Sequence: Synthetic oligonucleotide
auggauagcacuucaaucaccag

SEQ ID NO: 894 - RNA, 23 nt, Artificial Sequence
  Description of Artificial Sequence: Synthetic oligonucleotide
aguuuguuuucuucuucuauccc

SEQ ID NO: 895 - RNA, 23 nt, Artificial Sequence
  Description of Artificial Sequence: Synthetic oligonucleotide
agaacucauauuuggcauaauuu

SEQ ID NO: 896 - RNA, 23 nt, Artificial Sequence
  Description of Artificial Sequence: Synthetic oligonucleotide
aggaaaaaaauacauuggguuuu

SEQ ID NO: 897 - RNA, 23 nt, Artificial Sequence
  Description of Artificial Sequence: Synthetic oligonucleotide
accauaugcucuggaaaaaaaua

SEQ ID NO: 898 - RNA, 23 nt, Artificial Sequence
  Description of Artificial Sequence: Synthetic oligonucleotide
augcaaaagauaccauaugcucu

SEQ ID NO: 899 - RNA, 23 nt, Artificial Sequence
  Description of Artificial Sequence: Synthetic oligonucleotide
auugguuucaguugcaaaagaua

SEQ ID NO: 900 - RNA, 23 nt, Artificial Sequence
  Description of Artificial Sequence: Synthetic oligonucleotide
aauauuucaccauugguuucagu

SEQ ID NO: 901 - RNA, 23 nt, Artificial Sequence
  Description of Artificial Sequence: Synthetic oligonucleotide
aacaucugcaaaaucuguguggg

SEQ ID NO: 902 - RNA, 23 nt, Artificial Sequence
  Description of Artificial Sequence: Synthetic oligonucleotide
augaacucagaaacaucugcaaa

SEQ ID NO: 903 - RNA, 23 nt, Artificial Sequence
  Description of Artificial Sequence: Synthetic oligonucleotide
aggauaugugcuugaacucagaa

SEQ ID NO: 904 - RNA, 23 nt, Artificial Sequence
  Description of Artificial Sequence: Synthetic oligonucleotide
acaugaauuucaggauaugugcu

SEQ ID NO: 905 - RNA, 23 nt, Artificial Sequence
  Description of Artificial Sequence: Synthetic oligonucleotide
aauguaagaaaccaugaauuuca

SEQ ID NO: 906 - RNA, 23 nt, Artificial Sequence
  Description of Artificial Sequence: Synthetic oligonucleotide
auguucuuucgcauguaagaaac

SEQ ID NO: 907 - RNA, 23 nt, Artificial Sequence
  Description of Artificial Sequence: Synthetic oligonucleotide
aacuucuuucccuguucuuucgc

SEQ ID NO: 908 - RNA, 23 nt, Artificial Sequence
  Description of Artificial Sequence: Synthetic oligonucleotide
acagaucuucuuagaaaaaagua

SEQ ID NO: 909 - RNA, 23 nt, Artificial Sequence
  Description of Artificial Sequence: Synthetic oligonucleotide
agaaaaauauaaaccagaucuuc

SEQ ID NO: 910 - RNA, 23 nt, Artificial Sequence
  Description of Artificial Sequence: Synthetic oligonucleotide
agauguuccuuuaguagaaaaau

SEQ ID NO: 911 - RNA, 23 nt, Artificial Sequence
  Description of Artificial Sequence: Synthetic oligonucleotide
agcgguuccuuugauguuccuuu

SEQ ID NO: 912 - RNA, 23 nt, Artificial Sequence
  Description of Artificial Sequence: Synthetic oligonucleotide
acugcaaaugccgcgguuccuuu

SEQ ID NO: 913 - RNA, 23 nt, Artificial Sequence
  Description of Artificial Sequence: Synthetic oligonucleotide
aucgcugaaaaacugcaaaugcc

SEQ ID NO: 914 - RNA, 23 nt, Artificial Sequence
  Description of Artificial Sequence: Synthetic oligonucleotide
auauugccaaauucgcugaaaaa

SEQ ID NO: 915 - RNA, 23 nt, Artificial Sequence
  Description of Artificial Sequence: Synthetic oligonucleotide
acauaaauaucacuauugccaaa

SEQ ID NO: 916 - RNA, 23 nt, Artificial Sequence
  Description of Artificial Sequence: Synthetic oligonucleotide
augccagugacacauaaauauca

SEQ ID NO: 917 - RNA, 23 nt, Artificial Sequence
  Description of Artificial Sequence: Synthetic oligonucleotide
aguuagucggugcuccauguuuu

SEQ ID NO: 918 - RNA, 23 nt, Artificial Sequence
  Description of Artificial Sequence: Synthetic oligonucleotide
acagaauccauaguuagucggug

SEQ ID NO: 919 - RNA, 23 nt, Artificial Sequence
  Description of Artificial Sequence: Synthetic oligonucleotide
auaggcuuaaagcagaauccaua

SEQ ID NO: 920 - RNA, 23 nt, Artificial Sequence
  Description of Artificial Sequence: Synthetic oligonucleotide
aucccgcuuuguuaggcuuaaag

SEQ ID NO: 921 - RNA, 23 nt, Artificial Sequence
  Description of Artificial Sequence: Synthetic oligonucleotide
acagagcauuuucaggucucggg

SEQ ID NO: 922 - RNA, 23 nt, Artificial Sequence
  Description of Artificial Sequence: Synthetic oligonucleotide
acuucuucugcacagagcauuuu

SEQ ID NO: 923 - RNA, 23 nt, Artificial Sequence
  Description of Artificial Sequence: Synthetic oligonucleotide
accuacucugcucuucuucugca

SEQ ID NO: 924 - RNA, 23 nt, Artificial Sequence
  Description of Artificial Sequence: Synthetic oligonucleotide
aacccagcacguccuacucugcu

SEQ ID NO: 925 - RNA, 23 nt, Artificial Sequence
  Description of Artificial Sequence: Synthetic oligonucleotide
auaaucgcggucacccagcacgu

SEQ ID NO: 926 - RNA, 23 nt, Artificial Sequence
  Description of Artificial Sequence: Synthetic oligonucleotide
acuuaagcaaucuaaucgcgguc

SEQ ID NO: 927 - RNA, 23 nt, Artificial Sequence
  Description of Artificial Sequence: Synthetic oligonucleotide
augcaugccauacuuaagcaauc

SEQ ID NO: 928 - RNA, 23 nt, Artificial Sequence
  Description of Artificial Sequence: Synthetic oligonucleotide
aucugguacagcugcaugccaua

SEQ ID NO: 929 - RNA, 23 nt, Artificial Sequence
  Description of Artificial Sequence: Synthetic oligonucleotide
aaugcauauaauucugguacagc

SEQ ID NO: 930 - RNA, 23 nt, Artificial Sequence
  Description of Artificial Sequence: Synthetic oligonucleotide
accuugauauggaugcauauaau

SEQ ID NO: 931 - RNA, 23 nt, Artificial Sequence
  Description of Artificial Sequence: Synthetic oligonucleotide
aagccacuucuaccuugauaugg

SEQ ID NO: 932 - RNA, 23 nt, Artificial Sequence
  Description of Artificial Sequence: Synthetic oligonucleotide
acugugaacugcagccacuucua

SEQ ID NO: 933 - RNA, 23 nt, Artificial Sequence
  Description of Artificial Sequence: Synthetic oligonucleotide
aggugauaugcucugugaacugc

SEQ ID NO: 934 - RNA, 23 nt, Artificial Sequence
  Description of Artificial Sequence: Synthetic oligonucleotide
auacuucucauaggugauaugcu

SEQ ID NO: 935 - RNA, 23 nt, Artificial Sequence
  Description of Artificial Sequence: Synthetic oligonucleotide
aauucucugauauacuucucaua

SEQ ID NO: 936 - RNA, 23 nt, Artificial Sequence
  Description of Artificial Sequence: Synthetic oligonucleotide
agcuaccagggaauucucugaua

SEQ ID NO: 937 - RNA, 23 nt, Artificial Sequence
  Description of Artificial Sequence: Synthetic oligonucleotide
aagaaguccauugcuaccaggga

SEQ ID NO: 938 - RNA, 23 nt, Artificial Sequence
  Description of Artificial Sequence: Synthetic oligonucleotide
auuucuggccugagaaguccauu

SEQ ID NO: 939 - RNA, 23 nt, Artificial Sequence
  Description of Artificial Sequence: Synthetic oligonucleotide
aauaacucugcuuuucuggccug

SEQ ID NO: 940 - RNA, 23 nt, Artificial Sequence
  Description of Artificial Sequence: Synthetic oligonucleotide
augggauuuucuauaacucugcu

SEQ ID NO: 941 - RNA, 23 nt, Artificial Sequence
  Description of Artificial Sequence: Synthetic oligonucleotide
aaagggcuucagugggauuuucu

SEQ ID NO: 942 - RNA, 23 nt, Artificial Sequence
  Description of Artificial Sequence: Synthetic oligonucleotide
aaccgcaacugaaagggcuucag

SEQ ID NO: 943 - RNA, 23 nt, Artificial Sequence
  Description of Artificial Sequence: Synthetic oligonucleotide
aguccuucuucaaccgcaacuga

SEQ ID NO: 944 - RNA, 23 nt, Artificial Sequence
  Description of Artificial Sequence: Synthetic oligonucleotide
accuccaagcgaguccuucuuca

SEQ ID NO: 945 - RNA, 23 nt, Artificial Sequence
  Description of Artificial Sequence: Synthetic oligonucleotide
agcccaggcguaaacauccuuuu

SEQ ID NO: 946 - RNA, 23 nt, Artificial Sequence
  Description of Artificial Sequence: Synthetic oligonucleotide
acuaccgugagugcccaggcgua

SEQ ID NO: 947 - RNA, 23 nt, Artificial Sequence
  Description of Artificial Sequence: Synthetic oligonucleotide
aagcucugugaagaggcaguggg

SEQ ID NO: 948 - RNA, 23 nt, Artificial Sequence
  Description of Artificial Sequence: Synthetic oligonucleotide
aguuuguggcagagcucugugaa

SEQ ID NO: 949 - RNA, 23 nt, Artificial Sequence
  Description of Artificial Sequence: Synthetic oligonucleotide
auggauagccauguuuguggcag

SEQ ID NO: 950 - RNA, 23 nt, Artificial Sequence
  Description of Artificial Sequence: Synthetic oligonucleotide
agcugggaccgguggauagccau

SEQ ID NO: 951 - RNA, 23 nt, Artificial Sequence
  Description of Artificial Sequence: Synthetic oligonucleotide
agugaaaccauggcugggaccgg

SEQ ID NO: 952 - RNA, 23 nt, Artificial Sequence
  Description of Artificial Sequence: Synthetic oligonucleotide
agaaauuuuguggugaaaccaug

SEQ ID NO: 953 - RNA, 23 nt, Artificial Sequence
  Description of Artificial Sequence: Synthetic oligonucleotide
accucaucucuagaaauuuugug

SEQ ID NO: 954 - RNA, 23 nt, Artificial Sequence
  Description of Artificial Sequence: Synthetic oligonucleotide
acaaucgcugagccucaucucua

SEQ ID NO: 955 - RNA, 23 nt, Artificial Sequence
  Description of Artificial Sequence: Synthetic oligonucleotide
augcugaauaaucaaucgcugag

SEQ ID NO: 956 - RNA, 23 nt, Artificial Sequence
  Description of Artificial Sequence: Synthetic oligonucleotide
accacaaguccuugcugaauaau

SEQ ID NO: 957 - RNA, 23 nt, Artificial Sequence
  Description of Artificial Sequence: Synthetic oligonucleotide
agaaaacuccauccacaaguccu

SEQ ID NO: 958 - RNA, 23 nt, Artificial Sequence
  Description of Artificial Sequence: Synthetic oligonucleotide
aucccguaccaagaaaacuccau

SEQ ID NO: 959 - RNA, 23 nt, Artificial Sequence
  Description of Artificial Sequence: Synthetic oligonucleotide
auacucugacuaucccguaccaa

SEQ ID NO: 960 - RNA, 23 nt, Artificial Sequence
  Description of Artificial Sequence: Synthetic oligonucleotide
auugacaguacgaaaguuuuggg

SEQ ID NO: 961 - RNA, 23 nt, Artificial Sequence
  Description of Artificial Sequence: Synthetic oligonucleotide
auccaugacucauugacaguacg

SEQ ID NO: 962 - RNA, 23 nt, Artificial Sequence
  Description of Artificial Sequence: Synthetic oligonucleotide
agguauaauuugaaagugcuuua

SEQ ID NO: 963 - RNA, 23 nt, Artificial Sequence
  Description of Artificial Sequence: Synthetic oligonucleotide
acaucuucuacugguauaauuug

SEQ ID NO: 964 - RNA, 23 nt, Artificial Sequence
  Description of Artificial Sequence: Synthetic oligonucleotide
acauuucaccgucaucuucuacu

SEQ ID NO: 965 - RNA, 23 nt, Artificial Sequence
  Description of Artificial Sequence: Synthetic oligonucleotide
aaguguguggaacauuucaccgu

SEQ ID NO: 966 - RNA, 23 nt, Artificial Sequence
  Description of Artificial Sequence: Synthetic oligonucleotide
aggccaucauccaguguguggaa

SEQ ID NO: 967 - RNA, 23 nt, Artificial Sequence
  Description of Artificial Sequence: Synthetic oligonucleotide
aaaaucuuguguggccaucaucc

SEQ ID NO: 968 - RNA, 23 nt, Artificial Sequence
  Description of Artificial Sequence: Synthetic oligonucleotide
aauuagaucuguaaaucuugugu

SEQ ID NO: 969 - RNA, 23 nt, Artificial Sequence
  Description of Artificial Sequence: Synthetic oligonucleotide
accaccagcuguauuagaucugu

SEQ ID NO: 970 - RNA, 23 nt, Artificial Sequence
  Description of Artificial Sequence: Synthetic oligonucleotide
auugauagaacuccaccagcugu

SEQ ID NO: 971 - RNA, 23 nt, Artificial Sequence
  Description of Artificial Sequence: Synthetic oligonucleotide
acccuuauugaguugauagaacu

SEQ ID NO: 972 - RNA, 23 nt, Artificial Sequence
  Description of Artificial Sequence: Synthetic oligonucleotide
aaaggaagaacgcccuuauugag

SEQ ID NO: 973 - RNA, 23 nt, Artificial Sequence
  Description of Artificial Sequence: Synthetic oligonucleotide
auuucaacuugcaaggaagaacg

SEQ ID NO: 974 - RNA, 23 nt, Artificial Sequence
  Description of Artificial Sequence: Synthetic oligonucleotide
agcacaauaauguuucaacuugc

SEQ ID NO: 975 - RNA, 23 nt, Artificial Sequence
  Description of Artificial Sequence: Synthetic oligonucleotide
agagcaauccuagcacaauaaug

SEQ ID NO: 976 - RNA, 23 nt, Artificial Sequence
  Description of Artificial Sequence: Synthetic oligonucleotide
agcuugucuagagagcaauccua

SEQ ID NO: 977 - RNA, 23 nt, Artificial Sequence
  Description of Artificial Sequence: Synthetic oligonucleotide
aagucacuucuggcuugucuaga

SEQ ID NO: 978 - RNA, 23 nt, Artificial Sequence
  Description of Artificial Sequence: Synthetic oligonucleotide
aauaguuuaauaagucacuucug

SEQ ID NO: 979 - RNA, 23 nt, Artificial Sequence
  Description of Artificial Sequence: Synthetic oligonucleotide
accuuuuccuucaauaguuuaau

SEQ ID NO: 980 - RNA, 23 nt, Artificial Sequence
  Description of Artificial Sequence: Synthetic oligonucleotide
acccuuauuuauggucuuuuauu

SEQ ID NO: 981 - RNA, 23 nt, Artificial Sequence
  Description of Artificial Sequence: Synthetic oligonucleotide
auaauguuuucgcccuuauuuau

SEQ ID NO: 982 - RNA, 23 nt, Artificial Sequence
  Description of Artificial Sequence: Synthetic oligonucleotide
auuuucacaugguaauguuuucg

SEQ ID NO: 983 - RNA, 23 nt, Artificial Sequence
  Description of Artificial Sequence: Synthetic oligonucleotide
agaaauacauucuuuucacaugg

SEQ ID NO: 984 - RNA, 23 nt, Artificial Sequence
  Description of Artificial Sequence: Synthetic oligonucleotide
aaacuugcaggugaaauacauuc

SEQ ID NO: 985 - RNA, 23 nt, Artificial Sequence
  Description of Artificial Sequence: Synthetic oligonucleotide
auuugcaaugcacaaacuauuuu

SEQ ID NO: 986 - RNA, 23 nt, Artificial Sequence
  Description of Artificial Sequence: Synthetic oligonucleotide
agucuuugcuuauuugcaaugca

SEQ ID NO: 987 - RNA, 23 nt, Artificial Sequence
  Description of Artificial Sequence: Synthetic oligonucleotide
aagucaauccaagucuuugcuua

SEQ ID NO: 988 - RNA, 23 nt, Artificial Sequence
  Description of Artificial Sequence: Synthetic oligonucleotide
agaugaauguaaagucaauccaa

SEQ ID NO: 989 - RNA, 23 nt, Artificial Sequence
  Description of Artificial Sequence: Synthetic oligonucleotide
acaagaacacaccaagucauuuu

SEQ ID NO: 990 - RNA, 23 nt, Artificial Sequence
  Description of Artificial Sequence: Synthetic oligonucleotide
auaaaaaucacacaagaacacac

SEQ ID NO: 991 - RNA, 23 nt, Artificial Sequence
  Description of Artificial Sequence: Synthetic oligonucleotide
agagacauguuuuaaauaugcau

SEQ ID NO: 992 - RNA, 23 nt, Artificial Sequence
  Description of Artificial Sequence: Synthetic oligonucleotide
agguaaauaagggagacauguuu

SEQ ID NO: 993 - RNA, 23 nt, Artificial Sequence
  Description of Artificial Sequence: Synthetic oligonucleotide
auguugcuauaugguaaauaagg

SEQ ID NO: 994 - RNA, 23 nt, Artificial Sequence
  Description of Artificial Sequence: Synthetic oligonucleotide
acagaauucugauguugcuauau

SEQ ID NO: 995 - RNA, 23 nt, Artificial Sequence
  Description of Artificial Sequence: Synthetic oligonucleotide
aauuuuguguuucagaauucuga

SEQ ID NO: 996 - RNA, 23 nt, Artificial Sequence
  Description of Artificial Sequence: Synthetic oligonucleotide
agacucccaauuuauuucauauu

SEQ ID NO: 997 - RNA, 23 nt, Artificial Sequence
  Description of Artificial Sequence: Synthetic oligonucleotide
auaauuauuccugacucccaauu

SEQ ID NO: 998 - RNA, 21 nt, Artificial Sequence
  Description of Artificial Sequence: Synthetic oligonucleotide
gccggcgacaaugaccacuuu

SEQ ID NO: 999 - RNA, 21 nt, Artificial Sequence
  Description of Artificial Sequence: Synthetic oligonucleotide
ugaccacuucccugcaagauu

SEQ ID NO: 1000 - RNA, 21 nt, Artificial Sequence
  Description of Artificial Sequence: Synthetic oligonucleotide
gcugugcugcagacaggagau

SEQ ID NO: 1001 - RNA, 21 nt, Artificial Sequence
  Description of Artificial Sequence: Synthetic oligonucleotide
aagaaagaucuugauguuccu

SEQ ID NO: 1002 - RNA, 21 nt, Artificial Sequence
  Description of Artificial Sequence: Synthetic oligonucleotide
ugauguuccggaaaugccauu

SEQ ID NO: 1003 - RNA, 21 nt, Artificial Sequence
  Description of Artificial Sequence: Synthetic oligonucleotide
aaaugccaucuauuccaaacu

SEQ ID NO: 1004 - RNA, 21 nt, Artificial Sequence
  Description of Artificial Sequence: Synthetic oligonucleotide
auuccaaacccuuuuccugau

SEQ ID NO: 1005 - RNA, 21 nt, Artificial Sequence
  Description of Artificial Sequence: Synthetic oligonucleotide
uuuuccugagcuaugcuguuu

SEQ ID NO: 1006 - RNA, 21 nt, Artificial Sequence
  Description of Artificial Sequence: Synthetic oligonucleotide
uaugcuguucuccauuuacau

SEQ ID NO: 1007 - RNA, 21 nt, Artificial Sequence
  Description of Artificial Sequence: Synthetic oligonucleotide
ccauuuacaucuguguugucu

SEQ ID NO: 1008 - RNA, 21 nt, Artificial Sequence
  Description of Artificial Sequence: Synthetic oligonucleotide
uguguugucagcagaccuauu

SEQ ID NO: 1009 - RNA, 21 nt, Artificial Sequence
  Description of Artificial Sequence: Synthetic oligonucleotide
cagaccuauuucccaaagcau

SEQ ID NO: 1010 - RNA, 21 nt, Artificial Sequence
  Description of Artificial Sequence: Synthetic oligonucleotide
cccaaagcaaauucaaggaau

SEQ ID NO: 1011 - RNA, 21 nt, Artificial Sequence
  Description of Artificial Sequence: Synthetic oligonucleotide
aacaggugauuaaaguauacu

SEQ ID NO: 1012 - RNA, 21 nt, Artificial Sequence
  Description of Artificial Sequence: Synthetic oligonucleotide
aaaguauacagugaagaugau

SEQ ID NO: 1013 - RNA, 21 nt, Artificial Sequence
  Description of Artificial Sequence: Synthetic oligonucleotide
ugaagaugaaaccagcagggu

SEQ ID NO: 1014 - RNA, 21 nt, Artificial Sequence
  Description of Artificial Sequence: Synthetic oligonucleotide
ccagcagggcuuuagauguau

SEQ ID NO: 1015 - RNA, 21 nt, Artificial Sequence
  Description of Artificial Sequence: Synthetic oligonucleotide
uuagauguacccagugacauu

SEQ ID NO: 1016 - RNA, 21 nt, Artificial Sequence
  Description of Artificial Sequence: Synthetic oligonucleotide
cagugacauaacggcucgagu

SEQ ID NO: 1017 - RNA, 21 nt, Artificial Sequence
  Description of Artificial Sequence: Synthetic oligonucleotide
cggcucgagauguuugucagu

SEQ ID NO: 1018 - RNA, 21 nt, Artificial Sequence
  Description of Artificial Sequence: Synthetic oligonucleotide
guuugucagcuguugauccuu

SEQ ID NO: 1019 - RNA, 21 nt, Artificial Sequence
  Description of Artificial Sequence: Synthetic oligonucleotide
guugauccugaagaaucauuu

SEQ ID NO: 1020 - RNA, 21 nt, Artificial Sequence
  Description of Artificial Sequence: Synthetic oligonucleotide
agaaucauuacauugaugacu

SEQ ID NO: 1021 - RNA, 21 nt, Artificial Sequence
  Description of Artificial Sequence: Synthetic oligonucleotide
auugaugaccacagcuggacu

SEQ ID NO: 1022 - RNA, 21 nt, Artificial Sequence
  Description of Artificial Sequence: Synthetic oligonucleotide
cagcuggacccuuuuugagcu

SEQ ID NO: 1023 - RNA, 21 nt, Artificial Sequence
  Description of Artificial Sequence: Synthetic oligonucleotide
uuuuugagcaccugccucacu

SEQ ID NO: 1024 - RNA, 21 nt, Artificial Sequence
  Description of Artificial Sequence: Synthetic oligonucleotide
cugccucacauagguguagau

SEQ ID NO: 1025 - RNA, 21 nt, Artificial Sequence
  Description of Artificial Sequence: Synthetic oligonucleotide
agguguagaaagaacaauagu

SEQ ID NO: 1026 - RNA, 21 nt, Artificial Sequence
  Description of Artificial Sequence: Synthetic oligonucleotide
gaacaauagaagaccacgaau

SEQ ID NO: 1027 - RNA, 21 nt, Artificial Sequence
  Description of Artificial Sequence: Synthetic oligonucleotide
gaccacgaacuggugauugau

SEQ ID NO: 1028 - RNA, 21 nt, Artificial Sequence
  Description of Artificial Sequence: Synthetic oligonucleotide
ggugauugaagugcuauccau

SEQ ID NO: 1029 - RNA, 21 nt, Artificial Sequence
  Description of Artificial Sequence: Synthetic oligonucleotide
gauagaagaagaaaacaaacu

SEQ ID NO: 1030 - RNA, 21 nt, Artificial Sequence
  Description of Artificial Sequence: Synthetic oligonucleotide
auuaugccaaauaugaguucu

SEQ ID NO: 1031 - RNA, 21 nt, Artificial Sequence
  Description of Artificial Sequence: Synthetic oligonucleotide
aacccaauguauuuuuuuccu

SEQ ID NO: 1032 - RNA, 21 nt, Artificial Sequence
  Description of Artificial Sequence: Synthetic oligonucleotide
uuuuuuuccagagcauauggu

SEQ ID NO: 1033 - RNA, 21 nt, Artificial Sequence
  Description of Artificial Sequence: Synthetic oligonucleotide
agcauaugguaucuuuugcau

SEQ ID NO: 1034 - RNA, 21 nt, Artificial Sequence
  Description of Artificial Sequence: Synthetic oligonucleotide
ucuuuugcaacugaaaccaau

SEQ ID NO: 1035 - RNA, 21 nt, Artificial Sequence
  Description of Artificial Sequence: Synthetic oligonucleotide
ugaaaccaauggugaaauauu

SEQ ID NO: 1036 - RNA, 21 nt, Artificial Sequence
  Description of Artificial Sequence: Synthetic oligonucleotide
cacacagauuuugcagauguu

SEQ ID NO: 1037 - RNA, 21 nt, Artificial Sequence
  Description of Artificial Sequence: Synthetic oligonucleotide
ugcagauguuucugaguucau

SEQ ID NO: 1038 - RNA, 21 nt, Artificial Sequence
  Description of Artificial Sequence: Synthetic oligonucleotide
cugaguucaagcacauauccu

SEQ ID NO: 1039 - RNA, 21 nt, Artificial Sequence
  Description of Artificial Sequence: Synthetic oligonucleotide
cacauauccugaaauucaugu

SEQ ID NO: 1040 - RNA, 21 nt, Artificial Sequence
  Description of Artificial Sequence: Synthetic oligonucleotide
aaauucaugguuucuuacauu

SEQ ID NO: 1041 - RNA, 21 nt, Artificial Sequence
  Description of Artificial Sequence: Synthetic oligonucleotide
uucuuacaugcgaaagaacau

SEQ ID NO: 1042 - RNA, 21 nt, Artificial Sequence
  Description of Artificial Sequence: Synthetic oligonucleotide
gaaagaacagggaaagaaguu

SEQ ID NO: 1043 - RNA, 21 nt, Artificial Sequence
  Description of Artificial Sequence: Synthetic oligonucleotide
cuuuuuucuaagaagaucugu

SEQ ID NO: 1044 - RNA, 21 nt, Artificial Sequence
  Description of Artificial Sequence: Synthetic oligonucleotide
agaucugguuuauauuuuucu

SEQ ID NO: 1045 - RNA, 21 nt, Artificial Sequence
  Description of Artificial Sequence: Synthetic oligonucleotide
uuuucuacuaaaggaacaucu

SEQ ID NO: 1046 - RNA, 21 nt, Artificial Sequence
  Description of Artificial Sequence: Synthetic oligonucleotide
aggaacaucaaaggaaccgcu

SEQ ID NO: 1047 - RNA, 21 nt, Artificial Sequence
  Description of Artificial Sequence: Synthetic oligonucleotide
aggaaccgcggcauuugcagu

SEQ ID NO: 1048 - RNA, 21 nt, Artificial Sequence
  Description of Artificial Sequence: Synthetic oligonucleotide
cauuugcaguuuuucagcgau

SEQ ID NO: 1049 - RNA, 21 nt, Artificial Sequence
  Description of Artificial Sequence: Synthetic oligonucleotide
uuucagcgaauuuggcaauau

SEQ ID NO: 1050 - RNA, 21 nt, Artificial Sequence
  Description of Artificial Sequence: Synthetic oligonucleotide
uggcaauagugauauuuaugu

SEQ ID NO: 1051 - RNA, 21 nt, Artificial Sequence
  Description of Artificial Sequence: Synthetic oligonucleotide
auauuuaugugucacuggcau

SEQ ID NO: 1052 - RNA, 21 nt, Artificial Sequence
  Description of Artificial Sequence: Synthetic oligonucleotide
aacauggagcaccgacuaacu

SEQ ID NO: 1053 - RNA, 21 nt, Artificial Sequence
  Description of Artificial Sequence: Synthetic oligonucleotide
ccgacuaacuauggauucugu

SEQ ID NO: 1054 - RNA, 21 nt, Artificial Sequence
  Description of Artificial Sequence: Synthetic oligonucleotide
uggauucugcuuuaagccuau

SEQ ID NO: 1055 - RNA, 21 nt, Artificial Sequence
  Description of Artificial Sequence: Synthetic oligonucleotide
uuaagccuaacaaagcgggau

SEQ ID NO: 1056 - RNA, 21 nt, Artificial Sequence
  Description of Artificial Sequence: Synthetic oligonucleotide
cgagaccugaaaaugcucugu

SEQ ID NO: 1057 - RNA, 21 nt, Artificial Sequence
  Description of Artificial Sequence: Synthetic oligonucleotide
aaugcucugugcagaagaagu

SEQ ID NO: 1058 - RNA, 21 nt, Artificial Sequence
  Description of Artificial Sequence: Synthetic oligonucleotide
cagaagaagagcagaguaggu

SEQ ID NO: 1059 - RNA, 21 nt, Artificial Sequence
  Description of Artificial Sequence: Synthetic oligonucleotide
cagaguaggacgugcuggguu

SEQ ID NO: 1060 - RNA, 21 nt, Artificial Sequence
  Description of Artificial Sequence: Synthetic oligonucleotide
gugcugggugaccgcgauuau

SEQ ID NO: 1061 - RNA, 21 nt, Artificial Sequence
  Description of Artificial Sequence: Synthetic oligonucleotide
ccgcgauuagauugcuuaagu

SEQ ID NO: 1062 - RNA, 21 nt, Artificial Sequence
  Description of Artificial Sequence: Synthetic oligonucleotide
uugcuuaaguauggcaugcau

SEQ ID NO: 1063 - RNA, 21 nt, Artificial Sequence
  Description of Artificial Sequence: Synthetic oligonucleotide
uggcaugcagcuguaccagau

SEQ ID NO: 1064 - RNA, 21 nt, Artificial Sequence
  Description of Artificial Sequence: Synthetic oligonucleotide
uguaccagaauuauaugcauu

SEQ ID NO: 1065 - RNA, 21 nt, Artificial Sequence
  Description of Artificial Sequence: Synthetic oligonucleotide
uauaugcauccauaucaaggu

SEQ ID NO: 1066 - RNA, 21 nt, Artificial Sequence
  Description of Artificial Sequence: Synthetic oligonucleotide
auaucaagguagaaguggcuu

SEQ ID NO: 1067 - RNA, 21 nt, Artificial Sequence
  Description of Artificial Sequence: Synthetic oligonucleotide
gaaguggcugcaguucacagu

SEQ ID NO: 1068 - RNA, 21 nt, Artificial Sequence
  Description of Artificial Sequence: Synthetic oligonucleotide
aguucacagagcauaucaccu

SEQ ID NO: 1069 - RNA, 21 nt, Artificial Sequence
  Description of Artificial Sequence: Synthetic oligonucleotide
cauaucaccuaugagaaguau

SEQ ID NO: 1070 - RNA, 21 nt, Artificial Sequence
  Description of Artificial Sequence: Synthetic oligonucleotide
ugagaaguauaucagagaauu

SEQ ID NO: 1071 - RNA, 21 nt, Artificial Sequence
  Description of Artificial Sequence: Synthetic oligonucleotide
ucagagaauucccugguagcu

SEQ ID NO: 1072 - RNA, 21 nt, Artificial Sequence
  Description of Artificial Sequence: Synthetic oligonucleotide
ccugguagcaauggacuucuu

SEQ ID NO: 1073 - RNA, 21 nt, Artificial Sequence
  Description of Artificial Sequence: Synthetic oligonucleotide
uggacuucucaggccagaaau

SEQ ID NO: 1074 - RNA, 21 nt, Artificial Sequence
  Description of Artificial Sequence: Synthetic oligonucleotide
ggccagaaaagcagaguuauu

SEQ ID NO: 1075 - RNA, 21 nt, Artificial Sequence
  Description of Artificial Sequence: Synthetic oligonucleotide
cagaguuauagaaaaucccau

SEQ ID NO: 1076 - RNA, 21 nt, Artificial Sequence
  Description of Artificial Sequence: Synthetic oligonucleotide
aaaaucccacugaagcccuuu

SEQ ID NO: 1077 - RNA, 21 nt, Artificial Sequence
  Description of Artificial Sequence: Synthetic oligonucleotide
gaagcccuuucaguugcgguu

SEQ ID NO: 1078 - RNA, 21 nt, Artificial Sequence
  Description of Artificial Sequence: Synthetic oligonucleotide
aguugcgguugaagaaggacu

SEQ ID NO: 1079 - RNA, 21 nt, Artificial Sequence
  Description of Artificial Sequence: Synthetic oligonucleotide
aagaaggacucgcuuggaggu

SEQ ID NO: 1080 - RNA, 21 nt, Artificial Sequence
  Description of Artificial Sequence: Synthetic oligonucleotide
aaggauguuuacgccugggcu

SEQ ID NO: 1081 - RNA, 21 nt, Artificial Sequence
  Description of Artificial Sequence: Synthetic oligonucleotide
cgccugggcacucacgguagu

SEQ ID NO: 1082 - RNA, 21 nt, Artificial Sequence
  Description of Artificial Sequence: Synthetic oligonucleotide
cacugccucuucacagagcuu

SEQ ID NO: 1083 - RNA, 21 nt, Artificial Sequence
  Description of Artificial Sequence: Synthetic oligonucleotide
cacagagcucugccacaaacu

SEQ ID NO: 1084 - RNA, 21 nt, Artificial Sequence
  Description of Artificial Sequence: Synthetic oligonucleotide
gccacaaacauggcuauccau

SEQ ID NO: 1085 - RNA, 21 nt, Artificial Sequence
  Description of Artificial Sequence: Synthetic oligonucleotide
ggcuauccaccggucccagcu

SEQ ID NO: 1086 - RNA, 21 nt, Artificial Sequence
  Description of Artificial Sequence: Synthetic oligonucleotide
ggucccagccaugguuucacu

SEQ ID NO: 1087 - RNA, 21 nt, Artificial Sequence
  Description of Artificial Sequence: Synthetic oligonucleotide
ugguuucaccacaaaauuucu

SEQ ID NO: 1088 - RNA, 21 nt, Artificial Sequence
  Description of Artificial Sequence: Synthetic oligonucleotide
caaaauuucuagagaugaggu

SEQ ID NO: 1089 - RNA, 21 nt, Artificial Sequence
  Description of Artificial Sequence: Synthetic oligonucleotide
gagaugaggcucagcgauugu

SEQ ID NO: 1090 - RNA, 21 nt, Artificial Sequence
  Description of Artificial Sequence: Synthetic oligonucleotide
cagcgauugauuauucagcau

SEQ ID NO: 1091 - RNA, 21 nt, Artificial Sequence
  Description of Artificial Sequence: Synthetic oligonucleotide
uauucagcaaggacuuguggu

SEQ ID NO: 1092 - RNA, 21 nt, Artificial Sequence
  Description of Artificial Sequence: Synthetic oligonucleotide
gacuuguggauggaguuuucu

SEQ ID NO: 1093 - RNA, 21 nt, Artificial Sequence
  Description of Artificial Sequence: Synthetic oligonucleotide
ggaguuuucuugguacgggau

SEQ ID NO: 1094 - RNA, 21 nt, Artificial Sequence
  Description of Artificial Sequence: Synthetic oligonucleotide
gguacgggauagucagaguau

SEQ ID NO: 1095 - RNA, 21 nt, Artificial Sequence
  Description of Artificial Sequence: Synthetic oligonucleotide
caaaacuuucguacugucaau

SEQ ID NO: 1096 - RNA, 21 nt, Artificial Sequence
  Description of Artificial Sequence: Synthetic oligonucleotide
uacugucaaugagucauggau

SEQ ID NO: 1097 - RNA, 21 nt, Artificial Sequence
  Description of Artificial Sequence: Synthetic oligonucleotide
aagcacuuucaaauuauaccu

SEQ ID NO: 1098 - RNA, 21 nt, Artificial Sequence
  Description of Artificial Sequence: Synthetic oligonucleotide
aauuauaccaguagaagaugu

SEQ ID NO: 1099 - RNA, 21 nt, Artificial Sequence
  Description of Artificial Sequence: Synthetic oligonucleotide
uagaagaugacggugaaaugu

SEQ ID NO: 1100 - RNA, 21 nt, Artificial Sequence
  Description of Artificial Sequence: Synthetic oligonucleotide
ggugaaauguuccacacacuu

SEQ ID NO: 1101 - RNA, 21 nt, Artificial Sequence
  Description of Artificial Sequence: Synthetic oligonucleotide
ccacacacuggaugauggccu

SEQ ID NO: 1102 - RNA, 21 nt, Artificial Sequence
  Description of Artificial Sequence: Synthetic oligonucleotide
augauggccacacaagauuuu

SEQ ID NO: 1103 - RNA, 21 nt, Artificial Sequence
  Description of Artificial Sequence: Synthetic oligonucleotide
acaagauuuacagaucuaauu

SEQ ID NO: 1104 - RNA, 21 nt, Artificial Sequence
  Description of Artificial Sequence: Synthetic oligonucleotide
agaucuaauacagcugguggu

SEQ ID NO: 1105 - RNA, 21 nt, Artificial Sequence
  Description of Artificial Sequence: Synthetic oligonucleotide
agcugguggaguucuaucaau

SEQ ID NO: 1106 - RNA, 21 nt, Artificial Sequence
  Description of Artificial Sequence: Synthetic oligonucleotide
uucuaucaacucaauaagggu

SEQ ID NO: 1107 - RNA, 21 nt, Artificial Sequence
  Description of Artificial Sequence: Synthetic oligonucleotide
caauaagggcguucuuccuuu

SEQ ID NO: 1108 - RNA, 21 nt, Artificial Sequence
  Description of Artificial Sequence: Synthetic oligonucleotide
uucuuccuugcaaguugaaau

SEQ ID NO: 1109 - RNA, 21 nt, Artificial Sequence
  Description of Artificial Sequence: Synthetic oligonucleotide
aaguugaaacauuauugugcu

SEQ ID NO: 1110 - RNA, 21 nt, Artificial Sequence
  Description of Artificial Sequence: Synthetic oligonucleotide
uuauugugcuaggauugcucu

SEQ ID NO: 1111 - RNA, 21 nt, Artificial Sequence
  Description of Artificial Sequence: Synthetic oligonucleotide
ggauugcucucuagacaagcu

SEQ ID NO: 1112 - RNA, 21 nt, Artificial Sequence
  Description of Artificial Sequence: Synthetic oligonucleotide
uagacaagccagaagugacuu

SEQ ID NO: 1113 - RNA, 21 nt, Artificial Sequence
  Description of Artificial Sequence: Synthetic oligonucleotide
gaagugacuuauuaaacuauu

SEQ ID NO: 1114 - RNA, 21 nt, Artificial Sequence
  Description of Artificial Sequence: Synthetic oligonucleotide
uaaacuauugaaggaaaaggu

SEQ ID NO: 1115 - RNA, 21 nt, Artificial Sequence
  Description of Artificial Sequence: Synthetic oligonucleotide
uaaaagaccauaaauaagggu

SEQ ID NO: 1116 - RNA, 21 nt, Artificial Sequence
  Description of Artificial Sequence: Synthetic oligonucleotide
aaauaagggcgaaaacauuau

SEQ ID NO: 1117 - RNA, 21 nt, Artificial Sequence
  Description of Artificial Sequence: Synthetic oligonucleotide
aaaacauuaccaugugaaaau

SEQ ID NO: 1118 - RNA, 21 nt, Artificial Sequence
  Description of Artificial Sequence: Synthetic oligonucleotide
augugaaaagaauguauuucu

SEQ ID NO: 1119 - RNA, 21 nt, Artificial Sequence
  Description of Artificial Sequence: Synthetic oligonucleotide
auguauuucaccugcaaguuu

SEQ ID NO: 1120 - RNA, 21 nt, Artificial Sequence
  Description of Artificial Sequence: Synthetic oligonucleotide
aauaguuugugcauugcaaau

SEQ ID NO: 1121 - RNA, 21 nt, Artificial Sequence
  Description of Artificial Sequence: Synthetic oligonucleotide
cauugcaaauaagcaaagacu

SEQ ID NO: 1122 - RNA, 21 nt, Artificial Sequence
  Description of Artificial Sequence: Synthetic oligonucleotide
agcaaagacuuggauugacuu

SEQ ID NO: 1123 - RNA, 21 nt, Artificial Sequence
  Description of Artificial Sequence: Synthetic oligonucleotide
ggauugacuuuacauucaucu

SEQ ID NO: 1124 - RNA, 21 nt, Artificial Sequence
  Description of Artificial Sequence: Synthetic oligonucleotide
aaugacuugguguguucuugu

SEQ ID NO: 1125 - RNA, 21 nt, Artificial Sequence
  Description of Artificial Sequence: Synthetic oligonucleotide
guguucuugugugauuuuuau

SEQ ID NO: 1126 - RNA, 21 nt, Artificial Sequence
  Description of Artificial Sequence: Synthetic oligonucleotide
gcauauuuaaaacaugucucu

SEQ ID NO: 1127 - RNA, 21 nt, Artificial Sequence
  Description of Artificial Sequence: Synthetic oligonucleotide
acaugucucccuuauuuaccu

SEQ ID NO: 1128 - RNA, 21 nt, Artificial Sequence
  Description of Artificial Sequence: Synthetic oligonucleotide
uuauuuaccauauagcaacau

SEQ ID NO: 1129 - RNA, 21 nt, Artificial Sequence
  Description of Artificial Sequence: Synthetic oligonucleotide
auagcaacaucagaauucugu

SEQ ID NO: 1130 - RNA, 21 nt, Artificial Sequence
  Description of Artificial Sequence: Synthetic oligonucleotide
agaauucugaaacacaaaauu

SEQ ID NO: 1131 - RNA, 21 nt, Artificial Sequence
  Description of Artificial Sequence: Synthetic oligonucleotide
uaugaaauaaauugggagucu

SEQ ID NO: 1132 - RNA, 21 nt, Artificial Sequence
  Description of Artificial Sequence: Synthetic oligonucleotide
uugggagucaggaauaauuau

SEQ ID NO: 1133 - RNA, 23 nt, Artificial Sequence
  Description of Artificial Sequence: Synthetic oligonucleotide
aaaguggucauugucgccggccg

SEQ ID NO: 1134 - RNA, 23 nt, Artificial Sequence
  Description of Artificial Sequence: Synthetic oligonucleotide
aaucuugcagggaaguggucauu

SEQ ID NO: 1135 - RNA, 23 nt, Artificial Sequence
  Description of Artificial Sequence: Synthetic oligonucleotide
aucuccugucugcagcacagccg

SEQ ID NO: 1136 - RNA, 23 nt, Artificial Sequence
  Description of Artificial Sequence: Synthetic oligonucleotide
aggaacaucaagaucuuucuuuu

SEQ ID NO: 1137 - RNA, 23 nt, Artificial Sequence
  Description of Artificial Sequence: Synthetic oligonucleotide
aauggcauuuccggaacaucaag

SEQ ID NO: 1138 - RNA, 23 nt, Artificial Sequence
  Description of Artificial Sequence: Synthetic oligonucleotide
aguuuggaauagauggcauuucc

SEQ ID NO: 1139 - RNA, 23 nt, Artificial Sequence
  Description of Artificial Sequence: Synthetic oligonucleotide
aucaggaaaaggguuuggaauag

SEQ ID NO: 1140 - RNA, 23 nt, Artificial Sequence
  Description of Artificial Sequence: Synthetic oligonucleotide
aaacagcauagcucaggaaaagg

SEQ ID NO: 1141 - RNA, 23 nt, Artificial Sequence
  Description of Artificial Sequence: Synthetic oligonucleotide
auguaaauggagaacagcauagc

SEQ ID NO: 1142 - RNA, 23 nt, Artificial Sequence
  Description of Artificial Sequence: Synthetic oligonucleotide
agacaacacagauguaaauggag

SEQ ID NO: 1143 - RNA, 23 nt, Artificial Sequence
  Description of Artificial Sequence: Synthetic oligonucleotide
aauaggucugcugacaacacaga

SEQ ID NO: 1144 - RNA, 23 nt, Artificial Sequence
  Description of Artificial Sequence: Synthetic oligonucleotide
augcuuugggaaauaggucugcu

SEQ ID NO: 1145 - RNA, 23 nt, Artificial Sequence
  Description of Artificial Sequence: Synthetic oligonucleotide
auuccuugaauuugcuuugggaa

SEQ ID NO: 1146 - RNA, 23 nt, Artificial Sequence
  Description of Artificial Sequence: Synthetic oligonucleotide
aguauacuuuaaucaccuguuuu

SEQ ID NO: 1147 - RNA, 23 nt, Artificial Sequence
  Description of Artificial Sequence: Synthetic oligonucleotide
aucaucuucacuguauacuuuaa

SEQ ID NO: 1148 - RNA, 23 nt, Artificial Sequence
  Description of Artificial Sequence: Synthetic oligonucleotide
acccugcugguuucaucuucacu

SEQ ID NO: 1149 - RNA, 23 nt, Artificial Sequence
  Description of Artificial Sequence: Synthetic oligonucleotide
auacaucuaaagcccugcugguu

SEQ ID NO: 1150 - RNA, 23 nt, Artificial Sequence
  Description of Artificial Sequence: Synthetic oligonucleotide
aaugucacuggguacaucuaaag

SEQ ID NO: 1151 - RNA, 23 nt, Artificial Sequence
  Description of Artificial Sequence: Synthetic oligonucleotide
acucgagccguuaugucacuggg

SEQ ID NO: 1152 - RNA, 23 nt, Artificial Sequence
  Description of Artificial Sequence: Synthetic oligonucleotide
acugacaaacaucucgagccguu

SEQ ID NO: 1153 - RNA, 23 nt, Artificial Sequence
  Description of Artificial Sequence: Synthetic oligonucleotide
aaggaucaacagcugacaaacau

SEQ ID NO: 1154 - RNA, 23 nt, Artificial Sequence
  Description of Artificial Sequence: Synthetic oligonucleotide
aaaugauucuucaggaucaacag

SEQ ID NO: 1155 - RNA, 23 nt, Artificial Sequence
  Description of Artificial Sequence: Synthetic oligonucleotide
agucaucaauguaaugauucuuc

SEQ ID NO: 1156 - RNA, 23 nt, Artificial Sequence
  Description of Artificial Sequence: Synthetic oligonucleotide
aguccagcuguggucaucaaugu

SEQ ID NO: 1157 - RNA, 23 nt, Artificial Sequence
  Description of Artificial Sequence: Synthetic oligonucleotide
agcucaaaaaggguccagcugug

SEQ ID NO: 1158 - RNA, 23 nt, Artificial Sequence
  Description of Artificial Sequence: Synthetic oligonucleotide
agugaggcaggugcucaaaaagg

SEQ ID NO: 1159 - RNA, 23 nt, Artificial Sequence
  Description of Artificial Sequence: Synthetic oligonucleotide
aucuacaccuaugugaggcaggu

SEQ ID NO: 1160 - RNA, 23 nt, Artificial Sequence
  Description of Artificial Sequence: Synthetic oligonucleotide
acuauuguucuuucuacaccuau

SEQ ID NO: 1161 - RNA, 23 nt, Artificial Sequence
  Description of Artificial Sequence: Synthetic oligonucleotide
auucguggucuucuauuguucuu

SEQ ID NO: 1162 - RNA, 23 nt, Artificial Sequence
  Description of Artificial Sequence: Synthetic oligonucleotide
aucaaucaccaguucguggucuu

SEQ ID NO: 1163 - RNA, 23 nt, Artificial Sequence
  Description of Artificial Sequence: Synthetic oligonucleotide
auggauagcacuucaaucaccag

SEQ ID NO: 1164 - RNA, 23 nt, Artificial Sequence
  Description of Artificial Sequence: Synthetic oligonucleotide
aguuuguuuucuucuucuauccc

SEQ ID NO: 1165 - RNA, 23 nt, Artificial Sequence
  Description of Artificial Sequence: Synthetic oligonucleotide
agaacucauauuuggcauaauuu

SEQ ID NO: 1166 - RNA, 23 nt, Artificial Sequence
  Description of Artificial Sequence: Synthetic oligonucleotide
aggaaaaaaauacauuggguuuu

SEQ ID NO: 1167 - RNA, 23 nt, Artificial Sequence
  Description of Artificial Sequence: Synthetic oligonucleotide
accauaugcucuggaaaaaaaua

SEQ ID NO: 1168 - RNA, 23 nt, Artificial Sequence
  Description of Artificial Sequence: Synthetic oligonucleotide
augcaaaagauaccauaugcucu

SEQ ID NO: 1169 - RNA, 23 nt, Artificial Sequence
  Description of Artificial Sequence: Synthetic oligonucleotide
auugguuucaguugcaaaagaua

SEQ ID NO: 1170 - RNA, 23 nt, Artificial Sequence
  Description of Artificial Sequence: Synthetic oligonucleotide
aauauuucaccauugguuucagu

SEQ ID NO: 1171 - RNA, 23 nt, Artificial Sequence
  Description of Artificial Sequence: Synthetic oligonucleotide
aacaucugcaaaaucuguguggg

SEQ ID NO: 1172 - RNA, 23 nt, Artificial Sequence
  Description of Artificial Sequence: Synthetic oligonucleotide
augaacucagaaacaucugcaaa

SEQ ID NO: 1173 - RNA, 23 nt, Artificial Sequence
  Description of Artificial Sequence: Synthetic oligonucleotide
aggauaugugcuugaacucagaa

SEQ ID NO: 1174 - RNA, 23 nt, Artificial Sequence
  Description of Artificial Sequence: Synthetic oligonucleotide
acaugaauuucaggauaugugcu

SEQ ID NO: 1175 - RNA, 23 nt, Artificial Sequence
  Description of Artificial Sequence: Synthetic oligonucleotide
aauguaagaaaccaugaauuuca

SEQ ID NO: 1176 - RNA, 23 nt, Artificial Sequence
  Description of Artificial Sequence: Synthetic oligonucleotide
auguucuuucgcauguaagaaac

SEQ ID NO: 1177 - RNA, 23 nt, Artificial Sequence
  Description of Artificial Sequence: Synthetic oligonucleotide
aacuucuuucccuguucuuucgc

SEQ ID NO: 1178 - RNA, 23 nt, Artificial Sequence
  Description of Artificial Sequence: Synthetic oligonucleotide
acagaucuucuuagaaaaaagua

SEQ ID NO: 1179 - RNA, 23 nt, Artificial Sequence
  Description of Artificial Sequence: Synthetic oligonucleotide
agaaaaauauaaaccagaucuuc

SEQ ID NO: 1180 - RNA, 23 nt, Artificial Sequence
  Description of Artificial Sequence: Synthetic oligonucleotide
agauguuccuuuaguagaaaaau

SEQ ID NO: 1181 - RNA, 23 nt, Artificial Sequence
  Description of Artificial Sequence: Synthetic oligonucleotide
agcgguuccuuugauguuccuuu

SEQ ID NO: 1182 - RNA, 23 nt, Artificial Sequence
  Description of Artificial Sequence: Synthetic oligonucleotide
acugcaaaugccgcgguuccuuu

SEQ ID NO: 1183 - RNA, 23 nt, Artificial Sequence
  Description of Artificial Sequence: Synthetic oligonucleotide
aucgcugaaaaacugcaaaugcc

SEQ ID NO: 1184 - RNA, 23 nt, Artificial Sequence
  Description of Artificial Sequence: Synthetic oligonucleotide
auauugccaaauucgcugaaaaa

SEQ ID NO: 1185 - RNA, 23 nt, Artificial Sequence
  Description of Artificial Sequence: Synthetic oligonucleotide
acauaaauaucacuauugccaaa

SEQ ID NO: 1186 - RNA, 23 nt, Artificial Sequence
  Description of Artificial Sequence: Synthetic oligonucleotide
augccagugacacauaaauauca

SEQ ID NO: 1187 - RNA, 23 nt, Artificial Sequence
  Description of Artificial Sequence: Synthetic oligonucleotide
aguuagucggugcuccauguuuu

SEQ ID NO: 1188 - RNA, 23 nt, Artificial Sequence
  Description of Artificial Sequence: Synthetic oligonucleotide
acagaauccauaguuagucggug

SEQ ID NO: 1189 - RNA, 23 nt, Artificial Sequence
  Description of Artificial Sequence: Synthetic oligonucleotide
auaggcuuaaagcagaauccaua

SEQ ID NO: 1190 - RNA, 23 nt, Artificial Sequence
  Description of Artificial Sequence: Synthetic oligonucleotide
aucccgcuuuguuaggcuuaaag

SEQ ID NO: 1191 - RNA, 23 nt, Artificial Sequence
  Description of Artificial Sequence: Synthetic oligonucleotide
acagagcauuuucaggucucggg

SEQ ID NO: 1192 - RNA, 23 nt, Artificial Sequence
  Description of Artificial Sequence: Synthetic oligonucleotide
acuucuucugcacagagcauuuu

SEQ ID NO: 1193 - RNA, 23 nt, Artificial Sequence
  Description of Artificial Sequence: Synthetic oligonucleotide
accuacucugcucuucuucugca

SEQ ID NO: 1194 - RNA, 23 nt, Artificial Sequence
  Description of Artificial Sequence: Synthetic oligonucleotide
aacccagcacguccuacucugcu

SEQ ID NO: 1195 - RNA, 23 nt, Artificial Sequence
  Description of Artificial Sequence: Synthetic oligonucleotide
auaaucgcggucacccagcacgu

SEQ ID NO: 1196 - RNA, 23 nt, Artificial Sequence
  Description of Artificial Sequence: Synthetic oligonucleotide
acuuaagcaaucuaaucgcgguc

SEQ ID NO: 1197 - RNA, 23 nt, Artificial Sequence
  Description of Artificial Sequence: Synthetic oligonucleotide
augcaugccauacuuaagcaauc

SEQ ID NO: 1198 - RNA, 23 nt, Artificial Sequence
  Description of Artificial Sequence: Synthetic oligonucleotide
aucugguacagcugcaugccaua

SEQ ID NO: 1199 - RNA, 23 nt, Artificial Sequence
  Description of Artificial Sequence: Synthetic oligonucleotide
aaugcauauaauucugguacagc

SEQ ID NO: 1200 - RNA, 23 nt, Artificial Sequence
  Description of Artificial Sequence: Synthetic oligonucleotide
accuugauauggaugcauauaau

SEQ ID NO: 1201 - RNA, 23 nt, Artificial Sequence
  Description of Artificial Sequence: Synthetic oligonucleotide
aagccacuucuaccuugauaugg

SEQ ID NO: 1202 - RNA, 23 nt, Artificial Sequence
  Description of Artificial Sequence: Synthetic oligonucleotide
acugugaacugcagccacuucua

SEQ ID NO: 1203 - RNA, 23 nt, Artificial Sequence
  Description of Artificial Sequence: Synthetic oligonucleotide
aggugauaugcucugugaacugc

SEQ ID NO: 1204 - RNA, 23 nt, Artificial Sequence
  Description of Artificial Sequence: Synthetic oligonucleotide
auacuucucauaggugauaugcu

SEQ ID NO: 1205 - RNA, 23 nt, Artificial Sequence
  Description of Artificial Sequence: Synthetic oligonucleotide
aauucucugauauacuucucaua

SEQ ID NO: 1206 - RNA, 23 nt, Artificial Sequence
  Description of Artificial Sequence: Synthetic oligonucleotide
agcuaccagggaauucucugaua

SEQ ID NO: 1207 - RNA, 23 nt, Artificial Sequence
  Description of Artificial Sequence: Synthetic oligonucleotide
aagaaguccauugcuaccaggga

SEQ ID NO: 1208 - RNA, 23 nt, Artificial Sequence
  Description of Artificial Sequence: Synthetic oligonucleotide
auuucuggccugagaaguccauu

SEQ ID NO: 1209 - RNA, 23 nt, Artificial Sequence
  Description of Artificial Sequence: Synthetic oligonucleotide
aauaacucugcuuuucuggccug

SEQ ID NO: 1210 - RNA, 23 nt, Artificial Sequence
  Description of Artificial Sequence: Synthetic oligonucleotide
augggauuuucuauaacucugcu

SEQ ID NO: 1211 - RNA, 23 nt, Artificial Sequence
  Description of Artificial Sequence: Synthetic oligonucleotide
aaagggcuucagugggauuuucu

SEQ ID NO: 1212 - RNA, 23 nt, Artificial Sequence
  Description of Artificial Sequence: Synthetic oligonucleotide
aaccgcaacugaaagggcuucag

SEQ ID NO: 1213 - RNA, 23 nt, Artificial Sequence
  Description of Artificial Sequence: Synthetic oligonucleotide
aguccuucuucaaccgcaacuga

SEQ ID NO: 1214 - RNA, 23 nt, Artificial Sequence
  Description of Artificial Sequence: Synthetic oligonucleotide
accuccaagcgaguccuucuuca

SEQ ID NO: 1215 - RNA, 23 nt, Artificial Sequence
  Description of Artificial Sequence: Synthetic oligonucleotide
agcccaggcguaaacauccuuuu

SEQ ID NO: 1216 - RNA, 23 nt, Artificial Sequence
  Description of Artificial Sequence: Synthetic oligonucleotide
acuaccgugagugcccaggcgua

SEQ ID NO: 1217 - RNA, 23 nt, Artificial Sequence
  Description of Artificial Sequence: Synthetic oligonucleotide
aagcucugugaagaggcaguggg

SEQ ID NO: 1218 - RNA, 23 nt, Artificial Sequence
  Description of Artificial Sequence: Synthetic oligonucleotide
aguuuguggcagagcucugugaa

SEQ ID NO: 1219 - RNA, 23 nt, Artificial Sequence
  Description of Artificial Sequence: Synthetic oligonucleotide
auggauagccauguuuguggcag

SEQ ID NO: 1220 - RNA, 23 nt, Artificial Sequence
  Description of Artificial Sequence: Synthetic oligonucleotide
agcugggaccgguggauagccau

SEQ ID NO: 1221 - RNA, 23 nt, Artificial Sequence
  Description of Artificial Sequence: Synthetic oligonucleotide
agugaaaccauggcugggaccgg

SEQ ID NO: 1222 - RNA, 23 nt, Artificial Sequence
  Description of Artificial Sequence: Synthetic oligonucleotide
agaaauuuuguggugaaaccaug

SEQ ID NO: 1223 - RNA, 23 nt, Artificial Sequence
  Description of Artificial Sequence: Synthetic oligonucleotide
accucaucucuagaaauuuugug

SEQ ID NO: 1224 - RNA, 23 nt, Artificial Sequence
  Description of Artificial Sequence: Synthetic oligonucleotide
acaaucgcugagccucaucucua

SEQ ID NO: 1225 - RNA, 23 nt, Artificial Sequence
  Description of Artificial Sequence: Synthetic oligonucleotide
augcugaauaaucaaucgcugag

SEQ ID NO: 1226 - RNA, 23 nt, Artificial Sequence
  Description of Artificial Sequence: Synthetic oligonucleotide
accacaaguccuugcugaauaau

SEQ ID NO: 1227 - RNA, 23 nt, Artificial Sequence
  Description of Artificial Sequence: Synthetic oligonucleotide
agaaaacuccauccacaaguccu

SEQ ID NO: 1228 - RNA, 23 nt, Artificial Sequence
  Description of Artificial Sequence: Synthetic oligonucleotide
aucccguaccaagaaaacuccau

SEQ ID NO: 1229 - RNA, 23 nt, Artificial Sequence
  Description of Artificial Sequence: Synthetic oligonucleotide
auacucugacuaucccguaccaa

SEQ ID NO: 1230 - RNA, 23 nt, Artificial Sequence
  Description of Artificial Sequence: Synthetic oligonucleotide
auugacaguacgaaaguuuuggg

SEQ ID NO: 1231 - RNA, 23 nt, Artificial Sequence
  Description of Artificial Sequence: Synthetic oligonucleotide
auccaugacucauugacaguacg

SEQ ID NO: 1232 - RNA, 23 nt, Artificial Sequence
  Description of Artificial Sequence: Synthetic oligonucleotide
agguauaauuugaaagugcuuua

SEQ ID NO: 1233 - RNA, 23 nt, Artificial Sequence
  Description of Artificial Sequence: Synthetic oligonucleotide
acaucuucuacugguauaauuug

SEQ ID NO: 1234 - RNA, 23 nt, Artificial Sequence
  Description of Artificial Sequence: Synthetic oligonucleotide
acauuucaccgucaucuucuacu

SEQ ID NO: 1235 - RNA, 23 nt, Artificial Sequence
  Description of Artificial Sequence: Synthetic oligonucleotide
aaguguguggaacauuucaccgu

SEQ ID NO: 1236 - RNA, 23 nt, Artificial Sequence
  Description of Artificial Sequence: Synthetic oligonucleotide
aggccaucauccaguguguggaa

SEQ ID NO: 1237 - RNA, 23 nt, Artificial Sequence
  Description of Artificial Sequence: Synthetic oligonucleotide
aaaaucuuguguggccaucaucc

SEQ ID NO: 1238 - RNA, 23 nt, Artificial Sequence
  Description of Artificial Sequence: Synthetic oligonucleotide
aauuagaucuguaaaucuugugu

SEQ ID NO: 1239 - RNA, 23 nt, Artificial Sequence
  Description of Artificial Sequence: Synthetic oligonucleotide
accaccagcuguauuagaucugu

SEQ ID NO: 1240 - RNA, 23 nt, Artificial Sequence
  Description of Artificial Sequence: Synthetic oligonucleotide
auugauagaacuccaccagcugu

SEQ ID NO: 1241 - RNA, 23 nt, Artificial Sequence
  Description of Artificial Sequence: Synthetic oligonucleotide
acccuuauugaguugauagaacu

SEQ ID NO: 1242 - RNA, 23 nt, Artificial Sequence
  Description of Artificial Sequence: Synthetic oligonucleotide
aaaggaagaacgcccuuauugag

SEQ ID NO: 1243 - RNA, 23 nt, Artificial Sequence
  Description of Artificial Sequence: Synthetic oligonucleotide
auuucaacuugcaaggaagaacg

SEQ ID NO: 1244 - RNA, 23 nt, Artificial Sequence
  Description of Artificial Sequence: Synthetic oligonucleotide
agcacaauaauguuucaacuugc

SEQ ID NO: 1245 - RNA, 23 nt, Artificial Sequence
  Description of Artificial Sequence: Synthetic oligonucleotide
agagcaauccuagcacaauaaug

SEQ ID NO: 1246 - RNA, 23 nt, Artificial Sequence
  Description of Artificial Sequence: Synthetic oligonucleotide
agcuugucuagagagcaauccua

SEQ ID NO: 1247 - RNA, 23 nt, Artificial Sequence
  Description of Artificial Sequence: Synthetic oligonucleotide
aagucacuucuggcuugucuaga

SEQ ID NO: 1248 - RNA, 23 nt, Artificial Sequence
  Description of Artificial Sequence: Synthetic oligonucleotide
aauaguuuaauaagucacuucug

SEQ ID NO: 1249 - RNA, 23 nt, Artificial Sequence
  Description of Artificial Sequence: Synthetic oligonucleotide
accuuuuccuucaauaguuuaau

SEQ ID NO: 1250 - RNA, 23 nt, Artificial Sequence
  Description of Artificial Sequence: Synthetic oligonucleotide
acccuuauuuauggucuuuuauu

SEQ ID NO: 1251 - RNA, 23 nt, Artificial Sequence
  Description of Artificial Sequence: Synthetic oligonucleotide
auaauguuuucgcccuuauuuau

SEQ ID NO: 1252 - RNA, 23 nt, Artificial Sequence
  Description of Artificial Sequence: Synthetic oligonucleotide
auuuucacaugguaauguuuucg

SEQ ID NO: 1253 - RNA, 23 nt, Artificial Sequence
  Description of Artificial Sequence: Synthetic oligonucleotide
agaaauacauucuuuucacaugg

SEQ ID NO: 1254 - RNA, 23 nt, Artificial Sequence
  Description of Artificial Sequence: Synthetic oligonucleotide
aaacuugcaggugaaauacauuc

SEQ ID NO: 1255 - RNA, 23 nt, Artificial Sequence
  Description of Artificial Sequence: Synthetic oligonucleotide
auuugcaaugcacaaacuauuuu

SEQ ID NO: 1256 - RNA, 23 nt, Artificial Sequence
  Description of Artificial Sequence: Synthetic oligonucleotide
agucuuugcuuauuugcaaugca

SEQ ID NO: 1257 - RNA, 23 nt, Artificial Sequence
  Description of Artificial Sequence: Synthetic oligonucleotide
aagucaauccaagucuuugcuua

SEQ ID NO: 1258 - RNA, 23 nt, Artificial Sequence
  Description of Artificial Sequence: Synthetic oligonucleotide
agaugaauguaaagucaauccaa

SEQ ID NO: 1259 - RNA, 23 nt, Artificial Sequence
  Description of Artificial Sequence: Synthetic oligonucleotide
acaagaacacaccaagucauuuu

SEQ ID NO: 1260 - RNA, 23 nt, Artificial Sequence
  Description of Artificial Sequence: Synthetic oligonucleotide
auaaaaaucacacaagaacacac

SEQ ID NO: 1261 - RNA, 23 nt, Artificial Sequence
  Description of Artificial Sequence: Synthetic oligonucleotide
agagacauguuuuaaauaugcau

SEQ ID NO: 1262 - RNA, 23 nt, Artificial Sequence
  Description of Artificial Sequence: Synthetic oligonucleotide
agguaaauaagggagacauguuu

SEQ ID NO: 1263 - RNA, 23 nt, Artificial Sequence
  Description of Artificial Sequence: Synthetic oligonucleotide
auguugcuauaugguaaauaagg

SEQ ID NO: 1264 - RNA, 23 nt, Artificial Sequence
  Description of Artificial Sequence: Synthetic oligonucleotide
acagaauucugauguugcuauau

SEQ ID NO: 1265 - RNA, 23 nt, Artificial Sequence
  Description of Artificial Sequence: Synthetic oligonucleotide
aauuuuguguuucagaauucuga

SEQ ID NO: 1266 - RNA, 23 nt, Artificial Sequence
  Description of Artificial Sequence: Synthetic oligonucleotide
agacucccaauuuauuucauauu

SEQ ID NO: 1267 - RNA, 23 nt, Artificial Sequence
  Description of Artificial Sequence: Synthetic oligonucleotide
auaauuauuccugacucccaauu

SEQ ID NO: 1268 - RNA, 23 nt, Homo sapiens
cggccggcgacaaugaccacuuc

SEQ ID NO: 1269 - RNA, 23 nt, Homo sapiens
aaugaccacuucccugcaagaug

SEQ ID NO: 1270 - RNA, 23 nt, Homo sapiens
cggcugugcugcagacaggagaa

SEQ ID NO: 1271 - RNA, 23 nt, Homo sapiens
aaaagaaagaucuugauguuccg

SEQ ID NO: 1272 - RNA, 23 nt, Homo sapiens
cuugauguuccggaaaugccauc

SEQ ID NO: 1273 - RNA, 23 nt, Homo sapiens
ggaaaugccaucuauuccaaacc

SEQ ID NO: 1274 - RNA, 23 nt, Homo sapiens
cuauuccaaacccuuuuccugag

SEQ ID NO: 1275 - RNA, 23 nt, Homo sapiens
ccuuuuccugagcuaugcuguuc

SEQ ID NO: 1276 - RNA, 23 nt, Homo sapiens
gcuaugcuguucuccauuuacau

SEQ ID NO: 1277 - RNA, 23 nt, Homo sapiens
cuccauuuacaucuguguuguca

SEQ ID NO: 1278 - RNA, 23 nt, Homo sapiens
ucuguguugucagcagaccuauu

SEQ ID NO: 1279 - RNA, 23 nt, Homo sapiens
agcagaccuauuucccaaagcaa

SEQ ID NO: 1280 - RNA, 23 nt, Homo sapiens
uucccaaagcaaauucaaggaaa

SEQ ID NO: 1281 - RNA, 23 nt, Homo sapiens
aaaacaggugauuaaaguauaca

SEQ ID NO: 1282 - RNA, 23 nt, Homo sapiens
uuaaaguauacagugaagaugaa

SEQ ID NO: 1283 - RNA, 23 nt, Homo sapiens
agugaagaugaaaccagcagggc

SEQ ID NO: 1284 - RNA, 23 nt, Homo sapiens
aaccagcagggcuuuagauguac

SEQ ID NO: 1285 - RNA, 23 nt, Homo sapiens
cuuuagauguacccagugacaua

SEQ ID NO: 1286 - RNA, 23 nt, Homo sapiens
cccagugacauaacggcucgaga

SEQ ID NO: 1287 - RNA, 23 nt, Homo sapiens
aacggcucgagauguuugucagc

SEQ ID NO: 1288 - RNA, 23 nt, Homo sapiens
auguuugucagcuguugauccug

SEQ ID NO: 1289 - RNA, 23 nt, Homo sapiens
cuguugauccugaagaaucauua

SEQ ID NO: 1290 - RNA, 23 nt, Homo sapiens
gaagaaucauuacauugaugacc

SEQ ID NO: 1291 - RNA, 23 nt, Homo sapiens
acauugaugaccacagcuggacc

SEQ ID NO: 1292 - RNA, 23 nt, Homo sapiens
cacagcuggacccuuuuugagca

SEQ ID NO: 1293 - RNA, 23 nt, Homo sapiens
ccuuuuugagcaccugccucaca

SEQ ID NO: 1294 - RNA, 23 nt, Homo sapiens
accugccucacauagguguagaa

SEQ ID NO: 1295 - RNA, 23 nt, Homo sapiens
auagguguagaaagaacaauaga

SEQ ID NO: 1296 - RNA, 23 nt, Homo sapiens
aagaacaauagaagaccacgaac

SEQ ID NO: 1297 - RNA, 23 nt, Homo sapiens
aagaccacgaacuggugauugaa

SEQ ID NO: 1298 - RNA, 23 nt, Homo sapiens
cuggugauugaagugcuauccaa

SEQ ID NO: 1299 - RNA, 23 nt, Homo sapiens
gggauagaagaagaaaacaaacu

SEQ ID NO: 1300 - RNA, 23 nt, Homo sapiens
aaauuaugccaaauaugaguucu

SEQ ID NO: 1301 - RNA, 23 nt, Homo sapiens
aaaacccaauguauuuuuuucca

SEQ ID NO: 1302 - RNA, 23 nt, Homo sapiens
uauuuuuuuccagagcauauggu

SEQ ID NO: 1303 - RNA, 23 nt, Homo sapiens
agagcauaugguaucuuuugcaa

SEQ ID NO: 1304 - RNA, 23 nt, Homo sapiens
uaucuuuugcaacugaaaccaau

SEQ ID NO: 1305 - RNA, 23 nt, Homo sapiens
acugaaaccaauggugaaauauc

SEQ ID NO: 1306 - RNA, 23 nt, Homo sapiens
cccacacagauuuugcagauguu

SEQ ID NO: 1307 - RNA, 23 nt, Homo sapiens
uuugcagauguuucugaguucaa

SEQ ID NO: 1308 - RNA, 23 nt, Homo sapiens
uucugaguucaagcacauauccu

SEQ ID NO: 1309 - RNA, 23 nt, Homo sapiens
agcacauauccugaaauucaugg

SEQ ID NO: 1310 - RNA, 23 nt, Homo sapiens
ugaaauucaugguuucuuacaug

SEQ ID NO: 1311 - RNA, 23 nt, Homo sapiens
guuucuuacaugcgaaagaacag

SEQ ID NO: 1312 - RNA, 23 nt, Homo sapiens
gcgaaagaacagggaaagaaguc

SEQ ID NO: 1313 - RNA, 23 nt, Homo sapiens
uacuuuuuucuaagaagaucugg

SEQ ID NO: 1314 - RNA, 23 nt, Homo sapiens
gaagaucugguuuauauuuuucu

SEQ ID NO: 1315 - RNA, 23 nt, Homo sapiens
auuuuucuacuaaaggaacauca

SEQ ID NO: 1316 - RNA, 23 nt, Homo sapiens
aaaggaacaucaaaggaaccgcg

SEQ ID NO: 1317 - RNA, 23 nt, Homo sapiens
aaaggaaccgcggcauuugcagu

SEQ ID NO: 1318 - RNA, 23 nt, Homo sapiens
ggcauuugcaguuuuucagcgaa

SEQ ID NO: 1319 - RNA, 23 nt, Homo sapiens
uuuuucagcgaauuuggcaauag

SEQ ID NO: 1320 - RNA, 23 nt, Homo sapiens
uuuggcaauagugauauuuaugu

SEQ ID NO: 1321 - RNA, 23 nt, Homo sapiens
ugauauuuaugugucacuggcag

SEQ ID NO: 1322 - RNA, 23 nt, Homo sapiens
aaaacauggagcaccgacuaacu

SEQ ID NO: 1323 - RNA, 23 nt, Homo sapiens
caccgacuaacuauggauucugc

SEQ ID NO: 1324 - RNA, 23 nt, Homo sapiens
uauggauucugcuuuaagccuaa

SEQ ID NO: 1325 - RNA, 23 nt, Homo sapiens
cuuuaagccuaacaaagcgggag

SEQ ID NO: 1326 - RNA, 23 nt, Homo sapiens
cccgagaccugaaaaugcucugu

SEQ ID NO: 1327 - RNA, 23 nt, Homo sapiens
aaaaugcucugugcagaagaaga

SEQ ID NO: 1328 - RNA, 23 nt, Homo sapiens
ugcagaagaagagcagaguagga

SEQ ID NO: 1329 - RNA, 23 nt, Homo sapiens
agcagaguaggacgugcugggug

SEQ ID NO: 1330 - RNA, 23 nt, Homo sapiens
acgugcugggugaccgcgauuag

SEQ ID NO: 1331 - RNA, 23 nt, Homo sapiens
gaccgcgauuagauugcuuaagu

SEQ ID NO: 1332 - RNA, 23 nt, Homo sapiens
gauugcuuaaguauggcaugcag

SEQ ID NO: 1333 - RNA, 23 nt, Homo sapiens
uauggcaugcagcuguaccagaa

SEQ ID NO: 1334 - RNA, 23 nt, Homo sapiens
gcuguaccagaauuauaugcauc

SEQ ID NO: 1335 - RNA, 23 nt, Homo sapiens
auuauaugcauccauaucaaggu

SEQ ID NO: 1336 - RNA, 23 nt, Homo sapiens
ccauaucaagguagaaguggcug

SEQ ID NO: 1337 - RNA, 23 nt, Homo sapiens
uagaaguggcugcaguucacaga

SEQ ID NO: 1338 - RNA, 23 nt, Homo sapiens
gcaguucacagagcauaucaccu

SEQ ID NO: 1339 - RNA, 23 nt, Homo sapiens
agcauaucaccuaugagaaguau

SEQ ID NO: 1340 - RNA, 23 nt, Homo sapiens
uaugagaaguauaucagagaauu

SEQ ID NO: 1341 - RNA, 23 nt, Homo sapiens
uaucagagaauucccugguagca

SEQ ID NO: 1342 - RNA, 23 nt, Homo sapiens
ucccugguagcaauggacuucuc

SEQ ID NO: 1343 - RNA, 23 nt, Homo sapiens
aauggacuucucaggccagaaaa

SEQ ID NO: 1344 - RNA, 23 nt, Homo sapiens
caggccagaaaagcagaguuaua

SEQ ID NO: 1345 - RNA, 23 nt, Homo sapiens
agcagaguuauagaaaaucccac

SEQ ID NO: 1346 - RNA, 23 nt, Homo sapiens
agaaaaucccacugaagcccuuu

SEQ ID NO: 1347 - RNA, 23 nt, Homo sapiens
cugaagcccuuucaguugcgguu

SEQ ID NO: 1348 - RNA, 23 nt, Homo sapiens
ucaguugcgguugaagaaggacu

SEQ ID NO: 1349 - RNA, 23 nt, Homo sapiens
ugaagaaggacucgcuuggagga

SEQ ID NO: 1350 - RNA, 23 nt, Homo sapiens
aaaaggauguuuacgccugggca

SEQ ID NO: 1351 - RNA, 23 nt, Homo sapiens
uacgccugggcacucacgguagc

SEQ ID NO: 1352 - RNA, 23 nt, Homo sapiens
cccacugccucuucacagagcuc

SEQ ID NO: 1353 - RNA, 23 nt, Homo sapiens
uucacagagcucugccacaaaca

SEQ ID NO: 1354 - RNA, 23 nt, Homo sapiens
cugccacaaacauggcuauccac

SEQ ID NO: 1355 - RNA, 23 nt, Homo sapiens
auggcuauccaccggucccagcc

SEQ ID NO: 1356 - RNA, 23 nt, Homo sapiens
ccggucccagccaugguuucacc

SEQ ID NO: 1357 - RNA, 23 nt, Homo sapiens
caugguuucaccacaaaauuucu

SEQ ID NO: 1358 - RNA, 23 nt, Homo sapiens
cacaaaauuucuagagaugaggc

SEQ ID NO: 1359 - RNA, 23 nt, Homo sapiens
uagagaugaggcucagcgauuga

SEQ ID NO: 1360 - RNA, 23 nt, Homo sapiens
cucagcgauugauuauucagcaa

SEQ ID NO: 1361 - RNA, 23 nt, Homo sapiens
auuauucagcaaggacuugugga

SEQ ID NO: 1362 - RNA, 23 nt, Homo sapiens
aggacuuguggauggaguuuucu

SEQ ID NO: 1363 - RNA, 23 nt, Homo sapiens
auggaguuuucuugguacgggau

SEQ ID NO: 1364 - RNA, 23 nt, Homo sapiens
uugguacgggauagucagaguaa

SEQ ID NO: 1365 - RNA, 23 nt, Homo sapiens
cccaaaacuuucguacugucaau

SEQ ID NO: 1366 - RNA, 23 nt, Homo sapiens
cguacugucaaugagucauggac

SEQ ID NO: 1367 - RNA, 23 nt, Homo sapiens
uaaagcacuuucaaauuauacca

SEQ ID NO: 1368 - RNA, 23 nt, Homo sapiens
caaauuauaccaguagaagauga

SEQ ID NO: 1369 - RNA, 23 nt, Homo sapiens
aguagaagaugacggugaaaugu

SEQ ID NO: 1370 - RNA, 23 nt, Homo sapiens
acggugaaauguuccacacacug

SEQ ID NO: 1371 - RNA, 23 nt, Homo sapiens
uuccacacacuggaugauggcca

SEQ ID NO: 1372 - RNA, 23 nt, Homo sapiens
ggaugauggccacacaagauuua

SEQ ID NO: 1373 - RNA, 23 nt, Homo sapiens
acacaagauuuacagaucuaaua

SEQ ID NO: 1374 - RNA, 23 nt, Homo sapiens
acagaucuaauacagcuggugga

SEQ ID NO: 1375 - RNA, 23 nt, Homo sapiens
acagcugguggaguucuaucaac

SEQ ID NO: 1376 - RNA, 23 nt, Homo sapiens
aguucuaucaacucaauaagggc

SEQ ID NO: 1377 - RNA, 23 nt, Homo sapiens
cucaauaagggcguucuuccuug

SEQ ID NO: 1378 - RNA, 23 nt, Homo sapiens
cguucuuccuugcaaguugaaac

SEQ ID NO: 1379 - RNA, 23 nt, Homo sapiens
gcaaguugaaacauuauugugcu

SEQ ID NO: 1380 - RNA, 23 nt, Homo sapiens
cauuauugugcuaggauugcucu

SEQ ID NO: 1381 - RNA, 23 nt, Homo sapiens
uaggauugcucucuagacaagcc

SEQ ID NO: 1382 - RNA, 23 nt, Homo sapiens
ucuagacaagccagaagugacuu

SEQ ID NO: 1383 - RNA, 23 nt, Homo sapiens
cagaagugacuuauuaaacuauu

SEQ ID NO: 1384 - RNA, 23 nt, Homo sapiens
auuaaacuauugaaggaaaagga

SEQ ID NO: 1385 - RNA, 23 nt, Homo sapiens
aauaaaagaccauaaauaagggc

SEQ ID NO: 1386 - RNA, 23 nt, Homo sapiens
auaaauaagggcgaaaacauuac

SEQ ID NO: 1387 - RNA, 23 nt, Homo sapiens
cgaaaacauuaccaugugaaaag

SEQ ID NO: 1388 - RNA, 23 nt, Homo sapiens
ccaugugaaaagaauguauuuca

SEQ ID NO: 1389 - RNA, 23 nt, Homo sapiens
gaauguauuucaccugcaaguua

SEQ ID NO: 1390 - RNA, 23 nt, Homo sapiens
aaaauaguuugugcauugcaaau

SEQ ID NO: 1391 - RNA, 23 nt, Homo sapiens
ugcauugcaaauaagcaaagacu

SEQ ID NO: 1392 - RNA, 23 nt, Homo sapiens
uaagcaaagacuuggauugacuu

SEQ ID NO: 1393 - RNA, 23 nt, Homo sapiens
uuggauugacuuuacauucauca

SEQ ID NO: 1394 - RNA, 23 nt, Homo sapiens
aaaaugacuugguguguucuugu

SEQ ID NO: 1395 - RNA, 23 nt, Homo sapiens
guguguucuugugugauuuuuac

SEQ ID NO: 1396 - RNA, 23 nt, Homo sapiens
augcauauuuaaaacaugucucc

SEQ ID NO: 1397 - RNA, 23 nt, Homo sapiens
aaacaugucucccuuauuuacca

SEQ ID NO: 1398 - RNA, 23 nt, Homo sapiens
ccuuauuuaccauauagcaacau

SEQ ID NO: 1399 - RNA, 23 nt, Homo sapiens
auauagcaacaucagaauucuga

SEQ ID NO: 1400 - RNA, 23 nt, Homo sapiens
ucagaauucugaaacacaaaaua

SEQ ID NO: 1401 - RNA, 23 nt, Homo sapiens
aauaugaaauaaauugggaguca

SEQ ID NO: 1402 - RNA, 23 nt, Homo sapiens
aauugggagucaggaauaauuau

SEQ ID NO: 1403 - RNA, 21 nt, Artificial Sequence
  Description of Artificial Sequence: Synthetic oligonucleotide
gugauuaaaguauacagugau

SEQ ID NO: 1404 - RNA, 21 nt, Artificial Sequence
  Description of Artificial Sequence: Synthetic oligonucleotide
auuaaaguauacagugaagau

SEQ ID NO: 1405 - RNA, 21 nt, Artificial Sequence
  Description of Artificial Sequence: Synthetic oligonucleotide
guauacagugaagaugaaacu

SEQ ID NO: 1406 - RNA, 21 nt, Artificial Sequence
  Description of Artificial Sequence: Synthetic oligonucleotide
uacagugaagaugaaaccagu

SEQ ID NO: 1407 - RNA, 21 nt, Artificial Sequence
  Description of Artificial Sequence: Synthetic oligonucleotide
ucacauagguguagaaagaau

SEQ ID NO: 1408 - RNA, 21 nt, Artificial Sequence
  Description of Artificial Sequence: Synthetic oligonucleotide
cauagguguagaaagaacaau

SEQ ID NO: 1409 - RNA, 21 nt, Artificial Sequence
  Description of Artificial Sequence: Synthetic oligonucleotide
uguagaaagaacaauagaagu

SEQ ID NO: 1410 - RNA, 21 nt, Artificial Sequence
  Description of Artificial Sequence: Synthetic oligonucleotide
agaaagaacaauagaagaccu

SEQ ID NO: 1411 - RNA, 21 nt, Artificial Sequence
  Description of Artificial Sequence: Synthetic oligonucleotide
cgaacuggugauugaagugcu

SEQ ID NO: 1412 - RNA, 21 nt, Artificial Sequence
  Description of Artificial Sequence: Synthetic oligonucleotide
acuggugauugaagugcuauu

SEQ ID NO: 1413 - RNA, 21 nt, Artificial Sequence
  Description of Artificial Sequence: Synthetic oligonucleotide
gauugaagugcuauccaacuu

SEQ ID NO: 1414 - RNA, 21 nt, Artificial Sequence
  Description of Artificial Sequence: Synthetic oligonucleotide
agaagaagaaaacaaacuauu

SEQ ID NO: 1415 - RNA, 21 nt, Artificial Sequence
  Description of Artificial Sequence: Synthetic oligonucleotide
agaagaaaacaaacuauacuu

SEQ ID NO: 1416 - RNA, 21 nt, Artificial Sequence
  Description of Artificial Sequence: Synthetic oligonucleotide
augccaaauaugaguucuuuu

SEQ ID NO: 1417 - RNA, 21 nt, Artificial Sequence
  Description of Artificial Sequence: Synthetic oligonucleotide
uuuaaaaacccaauguauuuu

SEQ ID NO: 1418 - RNA, 21 nt, Artificial Sequence
  Description of Artificial Sequence: Synthetic oligonucleotide
uuccagagcauaugguaucuu

SEQ ID NO: 1419 - RNA, 21 nt, Artificial Sequence
  Description of Artificial Sequence: Synthetic oligonucleotide
cagagcauaugguaucuuuuu

SEQ ID NO: 1420 - RNA, 21 nt, Artificial Sequence
  Description of Artificial Sequence: Synthetic oligonucleotide
auaugguaucuuuugcaacuu

SEQ ID NO: 1421 - RNA, 21 nt, Artificial Sequence
  Description of Artificial Sequence: Synthetic oligonucleotide
augguaucuuuugcaacugau

SEQ ID NO: 1422 - RNA, 21 nt, Artificial Sequence
  Description of Artificial Sequence: Synthetic oligonucleotide
ugguaucuuuugcaacugaau

SEQ ID NO: 1423 - RNA, 21 nt, Artificial Sequence
  Description of Artificial Sequence: Synthetic oligonucleotide
guaucuuuugcaacugaaacu

SEQ ID NO: 1424 - RNA, 21 nt, Artificial Sequence
  Description of Artificial Sequence: Synthetic oligonucleotide
uuugcaacugaaaccaauggu

SEQ ID NO: 1425 - RNA, 21 nt, Artificial Sequence
  Description of Artificial Sequence: Synthetic oligonucleotide
gcaacugaaaccaauggugau

SEQ ID NO: 1426 - RNA, 21 nt, Artificial Sequence
  Description of Artificial Sequence: Synthetic oligonucleotide
agauuuugcagauguuucugu

SEQ ID NO: 1427 - RNA, 21 nt, Artificial Sequence
  Description of Artificial Sequence: Synthetic oligonucleotide
uuuugcagauguuucugaguu

SEQ ID NO: 1428 - RNA, 21 nt, Artificial Sequence
  Description of Artificial Sequence: Synthetic oligonucleotide
agauguuucugaguucaagcu

SEQ ID NO: 1429 - RNA, 21 nt, Artificial Sequence
  Description of Artificial Sequence: Synthetic oligonucleotide
uguuucugaguucaagcacau

SEQ ID NO: 1430 - RNA, 21 nt, Artificial Sequence
  Description of Artificial Sequence: Synthetic oligonucleotide
uucaagcacauauccugaaau

SEQ ID NO: 1431 - RNA, 21 nt, Artificial Sequence
  Description of Artificial Sequence: Synthetic oligonucleotide
aagcacauauccugaaauucu

SEQ ID NO: 1432 - RNA, 21 nt, Artificial Sequence
  Description of Artificial Sequence: Synthetic oligonucleotide
auauccugaaauucaugguuu

SEQ ID NO: 1433 - RNA, 21 nt, Artificial Sequence
  Description of Artificial Sequence: Synthetic oligonucleotide
auccugaaauucaugguuucu

SEQ ID NO: 1434 - RNA, 21 nt, Artificial Sequence
  Description of Artificial Sequence: Synthetic oligonucleotide
uccugaaauucaugguuucuu

SEQ ID NO: 1435 - RNA, 21 nt, Artificial Sequence
  Description of Artificial Sequence: Synthetic oligonucleotide
cugaaauucaugguuucuuau

SEQ ID NO: 1436 - RNA, 21 nt, Artificial Sequence
  Description of Artificial Sequence: Synthetic oligonucleotide
uucaugguuucuuacaugcgu

SEQ ID NO: 1437 - RNA, 21 nt, Artificial Sequence
  Description of Artificial Sequence: Synthetic oligonucleotide
augguuucuuacaugcgaaau

SEQ ID NO: 1438 - RNA, 21 nt, Artificial Sequence
  Description of Artificial Sequence: Synthetic oligonucleotide
ccgcggcauuugcaguuuuuu

SEQ ID NO: 1439 - RNA, 21 nt, Artificial Sequence
  Description of Artificial Sequence: Synthetic oligonucleotide
cggcauuugcaguuuuucagu

SEQ ID NO: 1440 - RNA, 21 nt, Artificial Sequence
  Description of Artificial Sequence: Synthetic oligonucleotide
uugcaguuuuucagcgaauuu

SEQ ID NO: 1441 - RNA, 21 nt, Artificial Sequence
  Description of Artificial Sequence: Synthetic oligonucleotide
gcaguuuuucagcgaauuugu

SEQ ID NO: 1442 - RNA, 21 nt, Artificial Sequence
  Description of Artificial Sequence: Synthetic oligonucleotide
caguuuuucagcgaauuuggu

SEQ ID NO: 1443 - RNA, 21 nt, Artificial Sequence
  Description of Artificial Sequence: Synthetic oligonucleotide
guuuuucagcgaauuuggcau

SEQ ID NO: 1444 - RNA, 21 nt, Artificial Sequence
  Description of Artificial Sequence: Synthetic oligonucleotide
cagcgaauuuggcaauagugu

SEQ ID NO: 1445 - RNA, 21 nt, Artificial Sequence
  Description of Artificial Sequence: Synthetic oligonucleotide
cgaauuuggcaauagugauau

SEQ ID NO: 1446 - RNA, 21 nt, Artificial Sequence
  Description of Artificial Sequence: Synthetic oligonucleotide
auuuggcaauagugauauuuu

SEQ ID NO: 1447 - RNA, 21 nt, Artificial Sequence
  Description of Artificial Sequence: Synthetic oligonucleotide
caauagugauauuuauguguu

SEQ ID NO: 1448 - RNA, 21 nt, Artificial Sequence
  Description of Artificial Sequence: Synthetic oligonucleotide
auagugauauuuaugugucau

SEQ ID NO: 1449 - RNA, 21 nt, Artificial Sequence
  Description of Artificial Sequence: Synthetic oligonucleotide
uagugauauuuaugugucacu

SEQ ID NO: 1450 - RNA, 21 nt, Artificial Sequence
  Description of Artificial Sequence: Synthetic oligonucleotide
gugauauuuaugugucacugu

SEQ ID NO: 1451 - RNA, 21 nt, Artificial Sequence
  Description of Artificial Sequence: Synthetic oligonucleotide
uuuaugugucacuggcaggcu

SEQ ID NO: 1452 - RNA, 21 nt, Artificial Sequence
  Description of Artificial Sequence: Synthetic oligonucleotide
augugucacuggcaggcaaau

SEQ ID NO: 1453 - RNA, 21 nt, Artificial Sequence
  Description of Artificial Sequence: Synthetic oligonucleotide
auggagcaccgacuaacuauu

SEQ ID NO: 1454 - RNA, 21 nt, Artificial Sequence
  Description of Artificial Sequence: Synthetic oligonucleotide
ggagcaccgacuaacuauggu

SEQ ID NO: 1455 - RNA, 21 nt, Artificial Sequence
  Description of Artificial Sequence: Synthetic oligonucleotide
gagcaccgacuaacuauggau

SEQ ID NO: 1456 - RNA, 21 nt, Artificial Sequence
  Description of Artificial Sequence: Synthetic oligonucleotide
gcaccgacuaacuauggauuu

SEQ ID NO: 1457 - RNA, 21 nt, Artificial Sequence
  Description of Artificial Sequence: Synthetic oligonucleotide
acuaacuauggauucugcuuu

SEQ ID NO: 1458 - RNA, 21 nt, Artificial Sequence
  Description of Artificial Sequence: Synthetic oligonucleotide
aacuauggauucugcuuuaau

SEQ ID NO: 1459 - RNA, 21 nt, Artificial Sequence
  Description of Artificial Sequence: Synthetic oligonucleotide
ugcagcuguaccagaauuauu

SEQ ID NO: 1460 - RNA, 21 nt, Artificial Sequence
  Description of Artificial Sequence: Synthetic oligonucleotide
agcuguaccagaauuauaugu

SEQ ID NO: 1461 - RNA, 21 nt, Artificial Sequence
  Description of Artificial Sequence: Synthetic oligonucleotide
accagaauuauaugcauccau

SEQ ID NO: 1462 - RNA, 21 nt, Artificial Sequence
  Description of Artificial Sequence: Synthetic oligonucleotide
agaauuauaugcauccauauu

SEQ ID NO: 1463 - RNA, 21 nt, Artificial Sequence
  Description of Artificial Sequence: Synthetic oligonucleotide
ggcugcaguucacagagcauu

SEQ ID NO: 1464 - RNA, 21 nt, Artificial Sequence
  Description of Artificial Sequence: Synthetic oligonucleotide
ugcaguucacagagcauaucu

SEQ ID NO: 1465 - RNA, 21 nt, Artificial Sequence
  Description of Artificial Sequence: Synthetic oligonucleotide
ucacagagcauaucaccuauu

SEQ ID NO: 1466 - RNA, 21 nt, Artificial Sequence
  Description of Artificial Sequence: Synthetic oligonucleotide
cagagcauaucaccuaugagu

SEQ ID NO: 1467 - RNA, 21 nt, Artificial Sequence
  Description of Artificial Sequence: Synthetic oligonucleotide
caccuaugagaaguauaucau

SEQ ID NO: 1468 - RNA, 21 nt, Artificial Sequence
  Description of Artificial Sequence: Synthetic oligonucleotide
cuaugagaaguauaucagagu

SEQ ID NO: 1469 - RNA, 21 nt, Artificial Sequence
  Description of Artificial Sequence: Synthetic oligonucleotide
gaaguauaucagagaauuccu

SEQ ID NO: 1470 - RNA, 21 nt, Artificial Sequence
  Description of Artificial Sequence: Synthetic oligonucleotide
aguauaucagagaauucccuu

SEQ ID NO: 1471 - RNA, 21 nt, Artificial Sequence
  Description of Artificial Sequence: Synthetic oligonucleotide
guauaucagagaauucccugu

SEQ ID NO: 1472 - RNA, 21 nt, Artificial Sequence
  Description of Artificial Sequence: Synthetic oligonucleotide
auaucagagaauucccugguu

SEQ ID NO: 1473 - RNA, 21 nt, Artificial Sequence
  Description of Artificial Sequence: Synthetic oligonucleotide
gagaauucccugguagcaauu

SEQ ID NO: 1474 - RNA, 21 nt, Artificial Sequence
  Description of Artificial Sequence: Synthetic oligonucleotide
gaauucccugguagcaauggu

SEQ ID NO: 1475 - RNA, 21 nt, Artificial Sequence
  Description of Artificial Sequence: Synthetic oligonucleotide
aauucccugguagcaauggau

SEQ ID NO: 1476 - RNA, 21 nt, Artificial Sequence
  Description of Artificial Sequence: Synthetic oligonucleotide
uucccugguagcaauggacuu

SEQ ID NO: 1477 - RNA, 21 nt, Artificial Sequence
  Description of Artificial Sequence: Synthetic oligonucleotide
gguagcaauggacuucucagu

SEQ ID NO: 1478 - RNA, 21 nt, Artificial Sequence
  Description of Artificial Sequence: Synthetic oligonucleotide
agcaauggacuucucaggccu

SEQ ID NO: 1479 - RNA, 21 nt, Artificial Sequence
  Description of Artificial Sequence: Synthetic oligonucleotide
cagccaugguuucaccacaau

SEQ ID NO: 1480 - RNA, 21 nt, Artificial Sequence
  Description of Artificial Sequence: Synthetic oligonucleotide
ccaugguuucaccacaaaauu

SEQ ID NO: 1481 - RNA, 21 nt, Artificial Sequence
  Description of Artificial Sequence: Synthetic oligonucleotide
uuucaccacaaaauuucuagu

SEQ ID NO: 1482 - RNA, 21 nt, Artificial Sequence
  Description of Artificial Sequence: Synthetic oligonucleotide
caccacaaaauuucuagagau

SEQ ID NO: 1483 - RNA, 21 nt, Artificial Sequence
  Description of Artificial Sequence: Synthetic oligonucleotide
guggauggaguuuucuugguu

SEQ ID NO: 1484 - RNA, 21 nt, Artificial Sequence
  Description of Artificial Sequence: Synthetic oligonucleotide
gauggaguuuucuugguacgu

SEQ ID NO: 1485 - RNA, 21 nt, Artificial Sequence
  Description of Artificial Sequence: Synthetic oligonucleotide
guuuucuugguacgggauagu

SEQ ID NO: 1486 - RNA, 21 nt, Artificial Sequence
  Description of Artificial Sequence: Synthetic oligonucleotide
uucuugguacgggauagucau

SEQ ID NO: 1487 - RNA, 21 nt, Artificial Sequence
  Description of Artificial Sequence: Synthetic oligonucleotide
aacuuucguacugucaaugau

SEQ ID NO: 1488 - RNA, 21 nt, Artificial Sequence
  Description of Artificial Sequence: Synthetic oligonucleotide
cuuucguacugucaaugaguu

SEQ ID NO: 1489 - RNA, 21 nt, Artificial Sequence
  Description of Artificial Sequence: Synthetic oligonucleotide
uuucguacugucaaugagucu

SEQ ID NO: 1490 - RNA, 21 nt, Artificial Sequence
  Description of Artificial Sequence: Synthetic oligonucleotide
ucguacugucaaugagucauu

SEQ ID NO: 1491 - RNA, 21 nt, Artificial Sequence
  Description of Artificial Sequence: Synthetic oligonucleotide
ugucaaugagucauggacaau

SEQ ID NO: 1492 - RNA, 21 nt, Artificial Sequence
  Description of Artificial Sequence: Synthetic oligonucleotide
uaauacagcugguggaguucu

SEQ ID NO: 1493 - RNA, 21 nt, Artificial Sequence
  Description of Artificial Sequence: Synthetic oligonucleotide
uacagcugguggaguucuauu

SEQ ID NO: 1494 - RNA, 21 nt, Artificial Sequence
  Description of Artificial Sequence: Synthetic oligonucleotide
ugguggaguucuaucaacucu

SEQ ID NO: 1495 - RNA, 21 nt, Artificial Sequence
  Description of Artificial Sequence: Synthetic oligonucleotide
uggaguucuaucaacucaauu

SEQ ID NO: 1496 - RNA, 21 nt, Artificial Sequence
  Description of Artificial Sequence: Synthetic oligonucleotide
agggcguucuuccuugcaagu

SEQ ID NO: 1497 - RNA, 21 nt, Artificial Sequence
  Description of Artificial Sequence: Synthetic oligonucleotide
gcguucuuccuugcaaguugu

SEQ ID NO: 1498 - RNA, 21 nt, Artificial Sequence
  Description of Artificial Sequence: Synthetic oligonucleotide
uuccuugcaaguugaaacauu

SEQ ID NO: 1499 - RNA, 21 nt, Artificial Sequence
  Description of Artificial Sequence: Synthetic oligonucleotide
cuugcaaguugaaacauuauu

SEQ ID NO: 1500 - RNA, 21 nt, Artificial Sequence
  Description of Artificial Sequence: Synthetic oligonucleotide
gcucucuagacaagccagaau

SEQ ID NO: 1501 - RNA, 21 nt, Artificial Sequence
  Description of Artificial Sequence: Synthetic oligonucleotide
cucuagacaagccagaagugu

SEQ ID NO: 1502 - RNA, 21 nt, Artificial Sequence
  Description of Artificial Sequence: Synthetic oligonucleotide
acaagccagaagugacuuauu

SEQ ID NO: 1503 - RNA, 21 nt, Artificial Sequence
  Description of Artificial Sequence: Synthetic oligonucleotide
agccagaagugacuuauuaau

SEQ ID NO: 1504 - RNA, 21 nt, Artificial Sequence
  Description of Artificial Sequence: Synthetic oligonucleotide
agggcgaaaacauuaccaugu

SEQ ID NO: 1505 - RNA, 21 nt, Artificial Sequence
  Description of Artificial Sequence: Synthetic oligonucleotide
gcgaaaacauuaccaugugau

SEQ ID NO: 1506 - RNA, 21 nt, Artificial Sequence
  Description of Artificial Sequence: Synthetic oligonucleotide
acauuaccaugugaaaagaau

SEQ ID NO: 1507 - RNA, 21 nt, Artificial Sequence
  Description of Artificial Sequence: Synthetic oligonucleotide
auuaccaugugaaaagaaugu

SEQ ID NO: 1508 - RNA, 21 nt, Artificial Sequence
  Description of Artificial Sequence: Synthetic oligonucleotide
uuaccaugugaaaagaauguu

SEQ ID NO: 1509 - RNA, 21 nt, Artificial Sequence
  Description of Artificial Sequence: Synthetic oligonucleotide
accaugugaaaagaauguauu

SEQ ID NO: 1510 - RNA, 21 nt, Artificial Sequence
  Description of Artificial Sequence: Synthetic oligonucleotide
ugaaaagaauguauuucaccu

SEQ ID NO: 1511 - RNA, 21 nt, Artificial Sequence
  Description of Artificial Sequence: Synthetic oligonucleotide
aaagaauguauuucaccugcu

SEQ ID NO: 1512 - RNA, 21 nt, Artificial Sequence
  Description of Artificial Sequence: Synthetic oligonucleotide
caaauaagcaaagacuuggau

SEQ ID NO: 1513 - RNA, 21 nt, Artificial Sequence
  Description of Artificial Sequence: Synthetic oligonucleotide
auaagcaaagacuuggauugu

SEQ ID NO: 1514 - RNA, 21 nt, Artificial Sequence
  Description of Artificial Sequence: Synthetic oligonucleotide
aaagacuuggauugacuuuau

SEQ ID NO: 1515 - RNA, 21 nt, Artificial Sequence
  Description of Artificial Sequence: Synthetic oligonucleotide
gacuuggauugacuuuacauu

SEQ ID NO: 1516 - RNA, 23 nt, Artificial Sequence
  Description of Artificial Sequence: Synthetic oligonucleotide
aucacuguauacuuuaaucaccu

SEQ ID NO: 1517 - RNA, 23 nt, Artificial Sequence
  Description of Artificial Sequence: Synthetic oligonucleotide
aucuucacuguauacuuuaauca

SEQ ID NO: 1518 - RNA, 23 nt, Artificial Sequence
  Description of Artificial Sequence: Synthetic oligonucleotide
aguuucaucuucacuguauacuu

SEQ ID NO: 1519 - RNA, 23 nt, Artificial Sequence
  Description of Artificial Sequence: Synthetic oligonucleotide
acugguuucaucuucacuguaua

SEQ ID NO: 1520 - RNA, 23 nt, Artificial Sequence
  Description of Artificial Sequence: Synthetic oligonucleotide
auucuuucuacaccuaugugagg

SEQ ID NO: 1521 - RNA, 23 nt, Artificial Sequence
  Description of Artificial Sequence: Synthetic oligonucleotide
auuguucuuucuacaccuaugug

SEQ ID NO: 1522 - RNA, 23 nt, Artificial Sequence
  Description of Artificial Sequence: Synthetic oligonucleotide
acuucuauuguucuuucuacacc

SEQ ID NO: 1523 - RNA, 23 nt, Artificial Sequence
  Description of Artificial Sequence: Synthetic oligonucleotide
aggucuucuauuguucuuucuac

SEQ ID NO: 1524 - RNA, 23 nt, Artificial Sequence
  Description of Artificial Sequence: Synthetic oligonucleotide
agcacuucaaucaccaguucgug

SEQ ID NO: 1525 - RNA, 23 nt, Artificial Sequence
  Description of Artificial Sequence: Synthetic oligonucleotide
aauagcacuucaaucaccaguuc

SEQ ID NO: 1526 - RNA, 23 nt, Artificial Sequence
  Description of Artificial Sequence: Synthetic oligonucleotide
aaguuggauagcacuucaaucac

SEQ ID NO: 1527 - RNA, 23 nt, Artificial Sequence
  Description of Artificial Sequence: Synthetic oligonucleotide
aauaguuuguuuucuucuucuau

SEQ ID NO: 1528 - RNA, 23 nt, Artificial Sequence
  Description of Artificial Sequence: Synthetic oligonucleotide
aaguauaguuuguuuucuucuuc

SEQ ID NO: 1529 - RNA, 23 nt, Artificial Sequence
  Description of Artificial Sequence: Synthetic oligonucleotide
aaaagaacucauauuuggcauaa

SEQ ID NO: 1530 - RNA, 23 nt, Artificial Sequence
  Description of Artificial Sequence: Synthetic oligonucleotide
aaaauacauuggguuuuuaaaga

SEQ ID NO: 1531 - RNA, 23 nt, Artificial Sequence
  Description of Artificial Sequence: Synthetic oligonucleotide
aagauaccauaugcucuggaaaa

SEQ ID NO: 1532 - RNA, 23 nt, Artificial Sequence
  Description of Artificial Sequence: Synthetic oligonucleotide
aaaaagauaccauaugcucugga

SEQ ID NO: 1533 - RNA, 23 nt, Artificial Sequence
  Description of Artificial Sequence: Synthetic oligonucleotide
aaguugcaaaagauaccauaugc

SEQ ID NO: 1534 - RNA, 23 nt, Artificial Sequence
  Description of Artificial Sequence: Synthetic oligonucleotide
aucaguugcaaaagauaccauau

SEQ ID NO: 1535 - RNA, 23 nt, Artificial Sequence
  Description of Artificial Sequence: Synthetic oligonucleotide
auucaguugcaaaagauaccaua

SEQ ID NO: 1536 - RNA, 23 nt, Artificial Sequence
  Description of Artificial Sequence: Synthetic oligonucleotide
aguuucaguugcaaaagauacca

SEQ ID NO: 1537 - RNA, 23 nt, Artificial Sequence
  Description of Artificial Sequence: Synthetic oligonucleotide
accauugguuucaguugcaaaag

SEQ ID NO: 1538 - RNA, 23 nt, Artificial Sequence
  Description of Artificial Sequence: Synthetic oligonucleotide
aucaccauugguuucaguugcaa

SEQ ID NO: 1539 - RNA, 23 nt, Artificial Sequence
  Description of Artificial Sequence: Synthetic oligonucleotide
acagaaacaucugcaaaaucugu

SEQ ID NO: 1540 - RNA, 23 nt, Artificial Sequence
  Description of Artificial Sequence: Synthetic oligonucleotide
aacucagaaacaucugcaaaauc

SEQ ID NO: 1541 - RNA, 23 nt, Artificial Sequence
  Description of Artificial Sequence: Synthetic oligonucleotide
agcuugaacucagaaacaucugc

SEQ ID NO: 1542 - RNA, 23 nt, Artificial Sequence
  Description of Artificial Sequence: Synthetic oligonucleotide
augugcuugaacucagaaacauc

SEQ ID NO: 1543 - RNA, 23 nt, Artificial Sequence
  Description of Artificial Sequence: Synthetic oligonucleotide
auuucaggauaugugcuugaacu

SEQ ID NO: 1544 - RNA, 23 nt, Artificial Sequence
  Description of Artificial Sequence: Synthetic oligonucleotide
agaauuucaggauaugugcuuga

SEQ ID NO: 1545 - RNA, 23 nt, Artificial Sequence
  Description of Artificial Sequence: Synthetic oligonucleotide
aaaccaugaauuucaggauaugu

SEQ ID NO: 1546 - RNA, 23 nt, Artificial Sequence
  Description of Artificial Sequence: Synthetic oligonucleotide
agaaaccaugaauuucaggauau

SEQ ID NO: 1547 - RNA, 23 nt, Artificial Sequence
  Description of Artificial Sequence: Synthetic oligonucleotide
aagaaaccaugaauuucaggaua

SEQ ID NO: 1548 - RNA, 23 nt, Artificial Sequence
  Description of Artificial Sequence: Synthetic oligonucleotide
auaagaaaccaugaauuucagga

SEQ ID NO: 1549 - RNA, 23 nt, Artificial Sequence
  Description of Artificial Sequence: Synthetic oligonucleotide
acgcauguaagaaaccaugaauu

SEQ ID NO: 1550 - RNA, 23 nt, Artificial Sequence
  Description of Artificial Sequence: Synthetic oligonucleotide
auuucgcauguaagaaaccauga

SEQ ID NO: 1551 - RNA, 23 nt, Artificial Sequence
  Description of Artificial Sequence: Synthetic oligonucleotide
aaaaaacugcaaaugccgcgguu

SEQ ID NO: 1552 - RNA, 23 nt, Artificial Sequence
  Description of Artificial Sequence: Synthetic oligonucleotide
acugaaaaacugcaaaugccgcg

SEQ ID NO: 1553 - RNA, 23 nt, Artificial Sequence
  Description of Artificial Sequence: Synthetic oligonucleotide
aaauucgcugaaaaacugcaaau

SEQ ID NO: 1554 - RNA, 23 nt, Artificial Sequence
  Description of Artificial Sequence: Synthetic oligonucleotide
acaaauucgcugaaaaacugcaa

SEQ ID NO: 1555 - RNA, 23 nt, Artificial Sequence
  Description of Artificial Sequence: Synthetic oligonucleotide
accaaauucgcugaaaaacugca

SEQ ID NO: 1556 - RNA, 23 nt, Artificial Sequence
  Description of Artificial Sequence: Synthetic oligonucleotide
augccaaauucgcugaaaaacug

SEQ ID NO: 1557 - RNA, 23 nt, Artificial Sequence
  Description of Artificial Sequence: Synthetic oligonucleotide
acacuauugccaaauucgcugaa

SEQ ID NO: 1558 - RNA, 23 nt, Artificial Sequence
  Description of Artificial Sequence: Synthetic oligonucleotide
auaucacuauugccaaauucgcu

SEQ ID NO: 1559 - RNA, 23 nt, Artificial Sequence
  Description of Artificial Sequence: Synthetic oligonucleotide
aaaauaucacuauugccaaauuc

SEQ ID NO: 1560 - RNA, 23 nt, Artificial Sequence
  Description of Artificial Sequence: Synthetic oligonucleotide
aacacauaaauaucacuauugcc

SEQ ID NO: 1561 - RNA, 23 nt, Artificial Sequence
  Description of Artificial Sequence: Synthetic oligonucleotide
augacacauaaauaucacuauug

SEQ ID NO: 1562 - RNA, 23 nt, Artificial Sequence
  Description of Artificial Sequence: Synthetic oligonucleotide
agugacacauaaauaucacuauu

SEQ ID NO: 1563 - RNA, 23 nt, Artificial Sequence
  Description of Artificial Sequence: Synthetic oligonucleotide
acagugacacauaaauaucacua

SEQ ID NO: 1564 - RNA, 23 nt, Artificial Sequence
  Description of Artificial Sequence: Synthetic oligonucleotide
agccugccagugacacauaaaua

SEQ ID NO: 1565 - RNA, 23 nt, Artificial Sequence
  Description of Artificial Sequence: Synthetic oligonucleotide
auuugccugccagugacacauaa

SEQ ID NO: 1566 - RNA, 23 nt, Artificial Sequence
  Description of Artificial Sequence: Synthetic oligonucleotide
aauaguuagucggugcuccaugu

SEQ ID NO: 1567 - RNA, 23 nt, Artificial Sequence
  Description of Artificial Sequence: Synthetic oligonucleotide
accauaguuagucggugcuccau

SEQ ID NO: 1568 - RNA, 23 nt, Artificial Sequence
  Description of Artificial Sequence: Synthetic oligonucleotide
auccauaguuagucggugcucca

SEQ ID NO: 1569 - RNA, 23 nt, Artificial Sequence
  Description of Artificial Sequence: Synthetic oligonucleotide
aaauccauaguuagucggugcuc

SEQ ID NO: 1570 - RNA, 23 nt, Artificial Sequence
  Description of Artificial Sequence: Synthetic oligonucleotide
aaagcagaauccauaguuagucg

SEQ ID NO: 1571 - RNA, 23 nt, Artificial Sequence
  Description of Artificial Sequence: Synthetic oligonucleotide
auuaaagcagaauccauaguuag

SEQ ID NO: 1572 - RNA, 23 nt, Artificial Sequence
  Description of Artificial Sequence: Synthetic oligonucleotide
aauaauucugguacagcugcaug

SEQ ID NO: 1573 - RNA, 23 nt, Artificial Sequence
  Description of Artificial Sequence: Synthetic oligonucleotide
acauauaauucugguacagcugc

SEQ ID NO: 1574 - RNA, 23 nt, Artificial Sequence
  Description of Artificial Sequence: Synthetic oligonucleotide
auggaugcauauaauucugguac

SEQ ID NO: 1575 - RNA, 23 nt, Artificial Sequence
  Description of Artificial Sequence: Synthetic oligonucleotide
aauauggaugcauauaauucugg

SEQ ID NO: 1576 - RNA, 23 nt, Artificial Sequence
  Description of Artificial Sequence: Synthetic oligonucleotide
aaugcucugugaacugcagccac

SEQ ID NO: 1577 - RNA, 23 nt, Artificial Sequence
  Description of Artificial Sequence: Synthetic oligonucleotide
agauaugcucugugaacugcagc

SEQ ID NO: 1578 - RNA, 23 nt, Artificial Sequence
  Description of Artificial Sequence: Synthetic oligonucleotide
aauaggugauaugcucugugaac

SEQ ID NO: 1579 - RNA, 23 nt, Artificial Sequence
  Description of Artificial Sequence: Synthetic oligonucleotide
acucauaggugauaugcucugug

SEQ ID NO: 1580 - RNA, 23 nt, Artificial Sequence
  Description of Artificial Sequence: Synthetic oligonucleotide
augauauacuucucauaggugau

SEQ ID NO: 1581 - RNA, 23 nt, Artificial Sequence
  Description of Artificial Sequence: Synthetic oligonucleotide
acucugauauacuucucauaggu

SEQ ID NO: 1582 - RNA, 23 nt, Artificial Sequence
  Description of Artificial Sequence: Synthetic oligonucleotide
aggaauucucugauauacuucuc

SEQ ID NO: 1583 - RNA, 23 nt, Artificial Sequence
  Description of Artificial Sequence: Synthetic oligonucleotide
aagggaauucucugauauacuuc

SEQ ID NO: 1584 - RNA, 23 nt, Artificial Sequence
  Description of Artificial Sequence: Synthetic oligonucleotide
acagggaauucucugauauacuu

SEQ ID NO: 1585 - RNA, 23 nt, Artificial Sequence
  Description of Artificial Sequence: Synthetic oligonucleotide
aaccagggaauucucugauauac

SEQ ID NO: 1586 - RNA, 23 nt, Artificial Sequence
  Description of Artificial Sequence: Synthetic oligonucleotide
aauugcuaccagggaauucucug

SEQ ID NO: 1587 - RNA, 23 nt, Artificial Sequence
  Description of Artificial Sequence: Synthetic oligonucleotide
accauugcuaccagggaauucuc

SEQ ID NO: 1588 - RNA, 23 nt, Artificial Sequence
  Description of Artificial Sequence: Synthetic oligonucleotide
auccauugcuaccagggaauucu

SEQ ID NO: 1589 - RNA, 23 nt, Artificial Sequence
  Description of Artificial Sequence: Synthetic oligonucleotide
aaguccauugcuaccagggaauu

SEQ ID NO: 1590 - RNA, 23 nt, Artificial Sequence
  Description of Artificial Sequence: Synthetic oligonucleotide
acugagaaguccauugcuaccag

SEQ ID NO: 1591 - RNA, 23 nt, Artificial Sequence
  Description of Artificial Sequence: Synthetic oligonucleotide
aggccugagaaguccauugcuac

SEQ ID NO: 1592 - RNA, 23 nt, Artificial Sequence
  Description of Artificial Sequence: Synthetic oligonucleotide
auuguggugaaaccauggcuggg

SEQ ID NO: 1593 - RNA, 23 nt, Artificial Sequence
  Description of Artificial Sequence: Synthetic oligonucleotide
aauuuuguggugaaaccauggcu

SEQ ID NO: 1594 - RNA, 23 nt, Artificial Sequence
  Description of Artificial Sequence: Synthetic oligonucleotide
acuagaaauuuuguggugaaacc

SEQ ID NO: 1595 - RNA, 23 nt, Artificial Sequence
  Description of Artificial Sequence: Synthetic oligonucleotide
aucucuagaaauuuuguggugaa

SEQ ID NO: 1596 - RNA, 23 nt, Artificial Sequence
  Description of Artificial Sequence: Synthetic oligonucleotide
aaccaagaaaacuccauccacaa

SEQ ID NO: 1597 - RNA, 23 nt, Artificial Sequence
  Description of Artificial Sequence: Synthetic oligonucleotide
acguaccaagaaaacuccaucca

SEQ ID NO: 1598 - RNA, 23 nt, Artificial Sequence
  Description of Artificial Sequence: Synthetic oligonucleotide
acuaucccguaccaagaaaacuc

SEQ ID NO: 1599 - RNA, 23 nt, Artificial Sequence
  Description of Artificial Sequence: Synthetic oligonucleotide
augacuaucccguaccaagaaaa

SEQ ID NO: 1600 - RNA, 23 nt, Artificial Sequence
  Description of Artificial Sequence: Synthetic oligonucleotide
aucauugacaguacgaaaguuuu

SEQ ID NO: 1601 - RNA, 23 nt, Artificial Sequence
  Description of Artificial Sequence: Synthetic oligonucleotide
aacucauugacaguacgaaaguu

SEQ ID NO: 1602 - RNA, 23 nt, Artificial Sequence
  Description of Artificial Sequence: Synthetic oligonucleotide
agacucauugacaguacgaaagu

SEQ ID NO: 1603 - RNA, 23 nt, Artificial Sequence
  Description of Artificial Sequence: Synthetic oligonucleotide
aaugacucauugacaguacgaaa

SEQ ID NO: 1604 - RNA, 23 nt, Artificial Sequence
  Description of Artificial Sequence: Synthetic oligonucleotide
auuguccaugacucauugacagu

SEQ ID NO: 1605 - RNA, 23 nt, Artificial Sequence
  Description of Artificial Sequence: Synthetic oligonucleotide
agaacuccaccagcuguauuaga

SEQ ID NO: 1606 - RNA, 23 nt, Artificial Sequence
  Description of Artificial Sequence: Synthetic oligonucleotide
aauagaacuccaccagcuguauu

SEQ ID NO: 1607 - RNA, 23 nt, Artificial Sequence
  Description of Artificial Sequence: Synthetic oligonucleotide
agaguugauagaacuccaccagc

SEQ ID NO: 1608 - RNA, 23 nt, Artificial Sequence
  Description of Artificial Sequence: Synthetic oligonucleotide
aauugaguugauagaacuccacc

SEQ ID NO: 1609 - RNA, 23 nt, Artificial Sequence
  Description of Artificial Sequence: Synthetic oligonucleotide
acuugcaaggaagaacgcccuua

SEQ ID NO: 1610 - RNA, 23 nt, Artificial Sequence
  Description of Artificial Sequence: Synthetic oligonucleotide
acaacuugcaaggaagaacgccc

SEQ ID NO: 1611 - RNA, 23 nt, Artificial Sequence
  Description of Artificial Sequence: Synthetic oligonucleotide
aauguuucaacuugcaaggaaga

SEQ ID NO: 1612 - RNA, 23 nt, Artificial Sequence
  Description of Artificial Sequence: Synthetic oligonucleotide
aauaauguuucaacuugcaagga

SEQ ID NO: 1613 - RNA, 23 nt, Artificial Sequence
  Description of Artificial Sequence: Synthetic oligonucleotide
auucuggcuugucuagagagcaa

SEQ ID NO: 1614 - RNA, 23 nt, Artificial Sequence
  Description of Artificial Sequence: Synthetic oligonucleotide
acacuucuggcuugucuagagag

SEQ ID NO: 1615 - RNA, 23 nt, Artificial Sequence
  Description of Artificial Sequence: Synthetic oligonucleotide
aauaagucacuucuggcuugucu

SEQ ID NO: 1616 - RNA, 23 nt, Artificial Sequence
  Description of Artificial Sequence: Synthetic oligonucleotide
auuaauaagucacuucuggcuug

SEQ ID NO: 1617 - RNA, 23 nt, Artificial Sequence
  Description of Artificial Sequence: Synthetic oligonucleotide
acaugguaauguuuucgcccuua

SEQ ID NO: 1618 - RNA, 23 nt, Artificial Sequence
  Description of Artificial Sequence: Synthetic oligonucleotide
aucacaugguaauguuuucgccc

SEQ ID NO: 1619 - RNA, 23 nt, Artificial Sequence
  Description of Artificial Sequence: Synthetic oligonucleotide
auucuuuucacaugguaauguuu

SEQ ID NO: 1620 - RNA, 23 nt, Artificial Sequence
  Description of Artificial Sequence: Synthetic oligonucleotide
acauucuuuucacaugguaaugu

SEQ ID NO: 1621 - RNA, 23 nt, Artificial Sequence
  Description of Artificial Sequence: Synthetic oligonucleotide
aacauucuuuucacaugguaaug

SEQ ID NO: 1622 - RNA, 23 nt, Artificial Sequence
  Description of Artificial Sequence: Synthetic oligonucleotide
aauacauucuuuucacaugguaa

SEQ ID NO: 1623 - RNA, 23 nt, Artificial Sequence
  Description of Artificial Sequence: Synthetic oligonucleotide
aggugaaauacauucuuuucaca

SEQ ID NO: 1624 - RNA, 23 nt, Artificial Sequence
  Description of Artificial Sequence: Synthetic oligonucleotide
agcaggugaaauacauucuuuuc

SEQ ID NO: 1625 - RNA, 23 nt, Artificial Sequence
  Description of Artificial Sequence: Synthetic oligonucleotide
auccaagucuuugcuuauuugca

SEQ ID NO: 1626 - RNA, 23 nt, Artificial Sequence
  Description of Artificial Sequence: Synthetic oligonucleotide
acaauccaagucuuugcuuauuu

SEQ ID NO: 1627 - RNA, 23 nt, Artificial Sequence
  Description of Artificial Sequence: Synthetic oligonucleotide
auaaagucaauccaagucuuugc

SEQ ID NO: 1628 - RNA, 23 nt, Artificial Sequence
  Description of Artificial Sequence: Synthetic oligonucleotide
aauguaaagucaauccaagucuu

SEQ ID NO: 1629 - RNA, 21 nt, Artificial Sequence
  Description of Artificial Sequence: Synthetic oligonucleotide
gugauuaaaguauacagugau

SEQ ID NO: 1630 - RNA, 21 nt, Artificial Sequence
  Description of Artificial Sequence: Synthetic oligonucleotide
auuaaaguauacagugaagau

SEQ ID NO: 1631 - RNA, 21 nt, Artificial Sequence
  Description of Artificial Sequence: Synthetic oligonucleotide
guauacagugaagaugaaacu

SEQ ID NO: 1632 - RNA, 21 nt, Artificial Sequence
  Description of Artificial Sequence: Synthetic oligonucleotide
uacagugaagaugaaaccagu

SEQ ID NO: 1633 - RNA, 21 nt, Artificial Sequence
  Description of Artificial Sequence: Synthetic oligonucleotide
ucacauagguguagaaagaau

SEQ ID NO: 1634 - RNA, 21 nt, Artificial Sequence
  Description of Artificial Sequence: Synthetic oligonucleotide
cauagguguagaaagaacaau

SEQ ID NO: 1635 - RNA, 21 nt, Artificial Sequence
  Description of Artificial Sequence: Synthetic oligonucleotide
uguagaaagaacaauagaagu

SEQ ID NO: 1636 - RNA, 21 nt, Artificial Sequence
  Description of Artificial Sequence: Synthetic oligonucleotide
agaaagaacaauagaagaccu

SEQ ID NO: 1637 - RNA, 21 nt, Artificial Sequence
  Description of Artificial Sequence: Synthetic oligonucleotide
cgaacuggugauugaagugcu

SEQ ID NO: 1638 - RNA, 21 nt, Artificial Sequence
  Description of Artificial Sequence: Synthetic oligonucleotide
acuggugauugaagugcuauu

SEQ ID NO: 1639 - RNA, 21 nt, Artificial Sequence
  Description of Artificial Sequence: Synthetic oligonucleotide
gauugaagugcuauccaacuu

SEQ ID NO: 1640 - RNA, 21 nt, Artificial Sequence
  Description of Artificial Sequence: Synthetic oligonucleotide
agaagaagaaaacaaacuauu

SEQ ID NO: 1641 - RNA, 21 nt, Artificial Sequence
  Description of Artificial Sequence: Synthetic oligonucleotide
agaagaaaacaaacuauacuu

SEQ ID NO: 1642 - RNA, 21 nt, Artificial Sequence
  Description of Artificial Sequence: Synthetic oligonucleotide
augccaaauaugaguucuuuu

SEQ ID NO: 1643 - RNA, 21 nt, Artificial Sequence
  Description of Artificial Sequence: Synthetic oligonucleotide
uuuaaaaacccaauguauuuu

SEQ ID NO: 1644 - RNA, 21 nt, Artificial Sequence
  Description of Artificial Sequence: Synthetic oligonucleotide
uuccagagcauaugguaucuu

SEQ ID NO: 1645 - RNA, 21 nt, Artificial Sequence
  Description of Artificial Sequence: Synthetic oligonucleotide
cagagcauaugguaucuuuuu

SEQ ID NO: 1646 - RNA, 21 nt, Artificial Sequence
  Description of Artificial Sequence: Synthetic oligonucleotide
auaugguaucuuuugcaacuu

SEQ ID NO: 1647 - RNA, 21 nt, Artificial Sequence
  Description of Artificial Sequence: Synthetic oligonucleotide
augguaucuuuugcaacugau

SEQ ID NO: 1648 - RNA, 21 nt, Artificial Sequence
  Description of Artificial Sequence: Synthetic oligonucleotide
ugguaucuuuugcaacugaau

SEQ ID NO: 1649 - RNA, 21 nt, Artificial Sequence
  Description of Artificial Sequence: Synthetic oligonucleotide
guaucuuuugcaacugaaacu

SEQ ID NO: 1650 - RNA, 21 nt, Artificial Sequence
  Description of Artificial Sequence: Synthetic oligonucleotide
uuugcaacugaaaccaauggu

SEQ ID NO: 1651 - RNA, 21 nt, Artificial Sequence
  Description of Artificial Sequence: Synthetic oligonucleotide
gcaacugaaaccaauggugau

SEQ ID NO: 1652 - RNA, 21 nt, Artificial Sequence
  Description of Artificial Sequence: Synthetic oligonucleotide
agauuuugcagauguuucugu

SEQ ID NO: 1653 - RNA, 21 nt, Artificial Sequence
  Description of Artificial Sequence: Synthetic oligonucleotide
uuuugcagauguuucugaguu

SEQ ID NO: 1654 - RNA, 21 nt, Artificial Sequence
  Description of Artificial Sequence: Synthetic oligonucleotide
agauguuucugaguucaagcu

SEQ ID NO: 1655 - RNA, 21 nt, Artificial Sequence
  Description of Artificial Sequence: Synthetic oligonucleotide
uguuucugaguucaagcacau

SEQ ID NO: 1656 - RNA, 21 nt, Artificial Sequence
  Description of Artificial Sequence: Synthetic oligonucleotide
uucaagcacauauccugaaau

SEQ ID NO: 1657 - RNA, 21 nt, Artificial Sequence
  Description of Artificial Sequence: Synthetic oligonucleotide
aagcacauauccugaaauucu

SEQ ID NO: 1658 - RNA, 21 nt, Artificial Sequence
  Description of Artificial Sequence: Synthetic oligonucleotide
auauccugaaauucaugguuu

SEQ ID NO: 1659 - RNA, 21 nt, Artificial Sequence
  Description of Artificial Sequence: Synthetic oligonucleotide
auccugaaauucaugguuucu

SEQ ID NO: 1660 - RNA, 21 nt, Artificial Sequence
  Description of Artificial Sequence: Synthetic oligonucleotide
uccugaaauucaugguuucuu

SEQ ID NO: 1661 - RNA, 21 nt, Artificial Sequence
  Description of Artificial Sequence: Synthetic oligonucleotide
cugaaauucaugguuucuuau

SEQ ID NO: 1662 - RNA, 21 nt, Artificial Sequence
  Description of Artificial Sequence: Synthetic oligonucleotide
uucaugguuucuuacaugcgu

SEQ ID NO: 1663 - RNA, 21 nt, Artificial Sequence
  Description of Artificial Sequence: Synthetic oligonucleotide
augguuucuuacaugcgaaau

SEQ ID NO: 1664 - RNA, 21 nt, Artificial Sequence
  Description of Artificial Sequence: Synthetic oligonucleotide
ccgcggcauuugcaguuuuuu

SEQ ID NO: 1665 - RNA, 21 nt, Artificial Sequence
  Description of Artificial Sequence: Synthetic oligonucleotide
cggcauuugcaguuuuucagu

SEQ ID NO: 1666 - RNA, 21 nt, Artificial Sequence
  Description of Artificial Sequence: Synthetic oligonucleotide
uugcaguuuuucagcgaauuu

SEQ ID NO: 1667 - RNA, 21 nt, Artificial Sequence
  Description of Artificial Sequence: Synthetic oligonucleotide
gcaguuuuucagcgaauuugu

SEQ ID NO: 1668 - RNA, 21 nt, Artificial Sequence
  Description of Artificial Sequence: Synthetic oligonucleotide
caguuuuucagcgaauuuggu

SEQ ID NO: 1669 - RNA, 21 nt, Artificial Sequence
  Description of Artificial Sequence: Synthetic oligonucleotide
guuuuucagcgaauuuggcau

SEQ ID NO: 1670 - RNA, 21 nt, Artificial Sequence
  Description of Artificial Sequence: Synthetic oligonucleotide
cagcgaauuuggcaauagugu

SEQ ID NO: 1671 - RNA, 21 nt, Artificial Sequence
  Description of Artificial Sequence: Synthetic oligonucleotide
cgaauuuggcaauagugauau

SEQ ID NO: 1672 - RNA, 21 nt, Artificial Sequence
  Description of Artificial Sequence: Synthetic oligonucleotide
auuuggcaauagugauauuuu

SEQ ID NO: 1673 - RNA, 21 nt, Artificial Sequence
  Description of Artificial Sequence: Synthetic oligonucleotide
caauagugauauuuauguguu

SEQ ID NO: 1674 - RNA, 21 nt, Artificial Sequence
  Description of Artificial Sequence: Synthetic oligonucleotide
auagugauauuuaugugucau

SEQ ID NO: 1675 - RNA, 21 nt, Artificial Sequence
  Description of Artificial Sequence: Synthetic oligonucleotide
uagugauauuuaugugucacu

SEQ ID NO: 1676 - RNA, 21 nt, Artificial Sequence
  Description of Artificial Sequence: Synthetic oligonucleotide
gugauauuuaugugucacugu

SEQ ID NO: 1677 - RNA, 21 nt, Artificial Sequence
  Description of Artificial Sequence: Synthetic oligonucleotide
uuuaugugucacuggcaggcu

SEQ ID NO: 1678 - RNA, 21 nt, Artificial Sequence
  Description of Artificial Sequence: Synthetic oligonucleotide
augugucacuggcaggcaaau

SEQ ID NO: 1679 - RNA, 21 nt, Artificial Sequence
  Description of Artificial Sequence: Synthetic oligonucleotide
auggagcaccgacuaacuauu

SEQ ID NO: 1680 - RNA, 21 nt, Artificial Sequence
  Description of Artificial Sequence: Synthetic oligonucleotide
ggagcaccgacuaacuauggu

SEQ ID NO: 1681 - RNA, 21 nt, Artificial Sequence
  Description of Artificial Sequence: Synthetic oligonucleotide
gagcaccgacuaacuauggau

SEQ ID NO: 1682 - RNA, 21 nt, Artificial Sequence
  Description of Artificial Sequence: Synthetic oligonucleotide
gcaccgacuaacuauggauuu

SEQ ID NO: 1683 - RNA, 21 nt, Artificial Sequence
  Description of Artificial Sequence: Synthetic oligonucleotide
acuaacuauggauucugcuuu

SEQ ID NO: 1684 - RNA, 21 nt, Artificial Sequence
  Description of Artificial Sequence: Synthetic oligonucleotide
aacuauggauucugcuuuaau

SEQ ID NO: 1685 - RNA, 21 nt, Artificial Sequence
  Description of Artificial Sequence: Synthetic oligonucleotide
ugcagcuguaccagaauuauu

SEQ ID NO: 1686 - RNA, 21 nt, Artificial Sequence
  Description of Artificial Sequence: Synthetic oligonucleotide
agcuguaccagaauuauaugu

SEQ ID NO: 1687 - RNA, 21 nt, Artificial Sequence
  Description of Artificial Sequence: Synthetic oligonucleotide
accagaauuauaugcauccau

SEQ ID NO: 1688 - RNA, 21 nt, Artificial Sequence
  Description of Artificial Sequence: Synthetic oligonucleotide
agaauuauaugcauccauauu

SEQ ID NO: 1689 - RNA, 21 nt, Artificial Sequence
  Description of Artificial Sequence: Synthetic oligonucleotide
ggcugcaguucacagagcauu

SEQ ID NO: 1690 - RNA, 21 nt, Artificial Sequence
  Description of Artificial Sequence: Synthetic oligonucleotide
ugcaguucacagagcauaucu

SEQ ID NO: 1691 - RNA, 21 nt, Artificial Sequence
  Description of Artificial Sequence: Synthetic oligonucleotide
ucacagagcauaucaccuauu

SEQ ID NO: 1692 - RNA, 21 nt, Artificial Sequence
  Description of Artificial Sequence: Synthetic oligonucleotide
cagagcauaucaccuaugagu

SEQ ID NO: 1693 - RNA, 21 nt, Artificial Sequence
  Description of Artificial Sequence: Synthetic oligonucleotide
caccuaugagaaguauaucau

SEQ ID NO: 1694 - RNA, 21 nt, Artificial Sequence
  Description of Artificial Sequence: Synthetic oligonucleotide
cuaugagaaguauaucagagu

SEQ ID NO: 1695 - RNA, 21 nt, Artificial Sequence
  Description of Artificial Sequence: Synthetic oligonucleotide
gaaguauaucagagaauuccu

SEQ ID NO: 1696 - RNA, 21 nt, Artificial Sequence
  Description of Artificial Sequence: Synthetic oligonucleotide
aguauaucagagaauucccuu

SEQ ID NO: 1697 - RNA, 21 nt, Artificial Sequence
  Description of Artificial Sequence: Synthetic oligonucleotide
guauaucagagaauucccugu

SEQ ID NO: 1698 - RNA, 21 nt, Artificial Sequence
  Description of Artificial Sequence: Synthetic oligonucleotide
auaucagagaauucccugguu

SEQ ID NO: 1699 - RNA, 21 nt, Artificial Sequence
  Description of Artificial Sequence: Synthetic oligonucleotide
gagaauucccugguagcaauu

SEQ ID NO: 1700 - RNA, 21 nt, Artificial Sequence
  Description of Artificial Sequence: Synthetic oligonucleotide
gaauucccugguagcaauggu

SEQ ID NO: 1701 - RNA, 21 nt, Artificial Sequence
  Description of Artificial Sequence: Synthetic oligonucleotide
aauucccugguagcaauggau

SEQ ID NO: 1702 - RNA, 21 nt, Artificial Sequence
  Description of Artificial Sequence: Synthetic oligonucleotide
uucccugguagcaauggacuu

SEQ ID NO: 1703 - RNA, 21 nt, Artificial Sequence
  Description of Artificial Sequence: Synthetic oligonucleotide
gguagcaauggacuucucagu

SEQ ID NO: 1704 - RNA, 21 nt, Artificial Sequence
  Description of Artificial Sequence: Synthetic oligonucleotide
agcaauggacuucucaggccu

SEQ ID NO: 1705 - RNA, 21 nt, Artificial Sequence
  Description of Artificial Sequence: Synthetic oligonucleotide
cagccaugguuucaccacaau

SEQ ID NO: 1706 - RNA, 21 nt, Artificial Sequence
  Description of Artificial Sequence: Synthetic oligonucleotide
ccaugguuucaccacaaaauu

SEQ ID NO: 1707 - RNA, 21 nt, Artificial Sequence
  Description of Artificial Sequence: Synthetic oligonucleotide
uuucaccacaaaauuucuagu

SEQ ID NO: 1708 - RNA, 21 nt, Artificial Sequence
  Description of Artificial Sequence: Synthetic oligonucleotide
caccacaaaauuucuagagau

SEQ ID NO: 1709 - RNA, 21 nt, Artificial Sequence
  Description of Artificial Sequence: Synthetic oligonucleotide
guggauggaguuuucuugguu

SEQ ID NO: 1710 - RNA, 21 nt, Artificial Sequence
  Description of Artificial Sequence: Synthetic oligonucleotide
gauggaguuuucuugguacgu

SEQ ID NO: 1711 - RNA, 21 nt, Artificial Sequence
  Description of Artificial Sequence: Synthetic oligonucleotide
guuuucuugguacgggauagu

SEQ ID NO: 1712 - RNA, 21 nt, Artificial Sequence
  Description of Artificial Sequence: Synthetic oligonucleotide
uucuugguacgggauagucau

SEQ ID NO: 1713 - RNA, 21 nt, Artificial Sequence
  Description of Artificial Sequence: Synthetic oligonucleotide
aacuuucguacugucaaugau

SEQ ID NO: 1714 - RNA, 21 nt, Artificial Sequence
  Description of Artificial Sequence: Synthetic oligonucleotide
cuuucguacugucaaugaguu

SEQ ID NO: 1715 - RNA, 21 nt, Artificial Sequence
  Description of Artificial Sequence: Synthetic oligonucleotide
uuucguacugucaaugagucu

SEQ ID NO: 1716 - RNA, 21 nt, Artificial Sequence
  Description of Artificial Sequence: Synthetic oligonucleotide
ucguacugucaaugagucauu

SEQ ID NO: 1717 - RNA, 21 nt, Artificial Sequence
  Description of Artificial Sequence: Synthetic oligonucleotide
ugucaaugagucauggacaau

SEQ ID NO: 1718 - RNA, 21 nt, Artificial Sequence
  Description of Artificial Sequence: Synthetic oligonucleotide
uaauacagcugguggaguucu

SEQ ID NO: 1719 - RNA, 21 nt, Artificial Sequence
  Description of Artificial Sequence: Synthetic oligonucleotide
uacagcugguggaguucuauu

SEQ ID NO: 1720 - RNA, 21 nt, Artificial Sequence
  Description of Artificial Sequence: Synthetic oligonucleotide
ugguggaguucuaucaacucu

SEQ ID NO: 1721 - RNA, 21 nt, Artificial Sequence
  Description of Artificial Sequence: Synthetic oligonucleotide
uggaguucuaucaacucaauu

SEQ ID NO: 1722 - RNA, 21 nt, Artificial Sequence
  Description of Artificial Sequence: Synthetic oligonucleotide
agggcguucuuccuugcaagu

SEQ ID NO: 1723 - RNA, 21 nt, Artificial Sequence
  Description of Artificial Sequence: Synthetic oligonucleotide
gcguucuuccuugcaaguugu

SEQ ID NO: 1724 - RNA, 21 nt, Artificial Sequence
  Description of Artificial Sequence: Synthetic oligonucleotide
uuccuugcaaguugaaacauu

SEQ ID NO: 1725 - RNA, 21 nt, Artificial Sequence
  Description of Artificial Sequence: Synthetic oligonucleotide
cuugcaaguugaaacauuauu

SEQ ID NO: 1726 - RNA, 21 nt, Artificial Sequence
  Description of Artificial Sequence: Synthetic oligonucleotide
gcucucuagacaagccagaau

SEQ ID NO: 1727 - RNA, 21 nt, Artificial Sequence
  Description of Artificial Sequence: Synthetic oligonucleotide
cucuagacaagccagaagugu

SEQ ID NO: 1728 - RNA, 21 nt, Artificial Sequence
  Description of Artificial Sequence: Synthetic oligonucleotide
acaagccagaagugacuuauu

SEQ ID NO: 1729 - RNA, 21 nt, Artificial Sequence
  Description of Artificial Sequence: Synthetic oligonucleotide
agccagaagugacuuauuaau

SEQ ID NO: 1730 - RNA, 21 nt, Artificial Sequence
  Description of Artificial Sequence: Synthetic oligonucleotide
agggcgaaaacauuaccaugu

SEQ ID NO: 1731 - RNA, 21 nt, Artificial Sequence
  Description of Artificial Sequence: Synthetic oligonucleotide
gcgaaaacauuaccaugugau

SEQ ID NO: 1732 - RNA, 21 nt, Artificial Sequence
  Description of Artificial Sequence: Synthetic oligonucleotide
acauuaccaugugaaaagaau

SEQ ID NO: 1733 - RNA, 21 nt, Artificial Sequence
  Description of Artificial Sequence: Synthetic oligonucleotide
auuaccaugugaaaagaaugu

SEQ ID NO: 1734 - RNA, 21 nt, Artificial Sequence
  Description of Artificial Sequence: Synthetic oligonucleotide
uuaccaugugaaaagaauguu

SEQ ID NO: 1735 - RNA, 21 nt, Artificial Sequence
  Description of Artificial Sequence: Synthetic oligonucleotide
accaugugaaaagaauguauu

SEQ ID NO: 1736 - RNA, 21 nt, Artificial Sequence
  Description of Artificial Sequence: Synthetic oligonucleotide
ugaaaagaauguauuucaccu

SEQ ID NO: 1737 - RNA, 21 nt, Artificial Sequence
  Description of Artificial Sequence: Synthetic oligonucleotide
aaagaauguauuucaccugcu

SEQ ID NO: 1738 - RNA, 21 nt, Artificial Sequence
  Description of Artificial Sequence: Synthetic oligonucleotide
caaauaagcaaagacuuggau

SEQ ID NO: 1739 - RNA, 21 nt, Artificial Sequence
  Description of Artificial Sequence: Synthetic oligonucleotide
auaagcaaagacuuggauugu

SEQ ID NO: 1740 - RNA, 21 nt, Artificial Sequence
  Description of Artificial Sequence: Synthetic oligonucleotide
aaagacuuggauugacuuuau

SEQ ID NO: 1741 - RNA, 21 nt, Artificial Sequence
  Description of Artificial Sequence: Synthetic oligonucleotide
gacuuggauugacuuuacauu

SEQ ID NO: 1742 - RNA, 23 nt, Artificial Sequence
  Description of Artificial Sequence: Synthetic oligonucleotide
aucacuguauacuuuaaucaccu

SEQ ID NO: 1743 - RNA, 23 nt, Artificial Sequence
  Description of Artificial Sequence: Synthetic oligonucleotide
aucuucacuguauacuuuaauca

SEQ ID NO: 1744 - RNA, 23 nt, Artificial Sequence
  Description of Artificial Sequence: Synthetic oligonucleotide
aguuucaucuucacuguauacuu

SEQ ID NO: 1745 - RNA, 23 nt, Artificial Sequence
  Description of Artificial Sequence: Synthetic oligonucleotide
acugguuucaucuucacuguaua

SEQ ID NO: 1746 - RNA, 23 nt, Artificial Sequence
  Description of Artificial Sequence: Synthetic oligonucleotide
auucuuucuacaccuaugugagg

SEQ ID NO: 1747 - RNA, 23 nt, Artificial Sequence
  Description of Artificial Sequence: Synthetic oligonucleotide
auuguucuuucuacaccuaugug

SEQ ID NO: 1748 - RNA, 23 nt, Artificial Sequence
  Description of Artificial Sequence: Synthetic oligonucleotide
acuucuauuguucuuucuacacc

SEQ ID NO: 1749 - RNA, 23 nt, Artificial Sequence
  Description of Artificial Sequence: Synthetic oligonucleotide
aggucuucuauuguucuuucuac

SEQ ID NO: 1750 - RNA, 23 nt, Artificial Sequence
  Description of Artificial Sequence: Synthetic oligonucleotide
agcacuucaaucaccaguucgug

SEQ ID NO: 1751 - RNA, 23 nt, Artificial Sequence
  Description of Artificial Sequence: Synthetic oligonucleotide
aauagcacuucaaucaccaguuc

SEQ ID NO: 1752 - RNA, 23 nt, Artificial Sequence
  Description of Artificial Sequence: Synthetic oligonucleotide
aaguuggauagcacuucaaucac

SEQ ID NO: 1753 - RNA, 23 nt, Artificial Sequence
  Description of Artificial Sequence: Synthetic oligonucleotide
aauaguuuguuuucuucuucuau

SEQ ID NO: 1754 - RNA, 23 nt, Artificial Sequence
  Description of Artificial Sequence: Synthetic oligonucleotide
aaguauaguuuguuuucuucuuc

SEQ ID NO: 1755 - RNA, 23 nt, Artificial Sequence
  Description of Artificial Sequence: Synthetic oligonucleotide
aaaagaacucauauuuggcauaa

SEQ ID NO: 1756 - RNA, 23 nt, Artificial Sequence
  Description of Artificial Sequence: Synthetic oligonucleotide
aaaauacauuggguuuuuaaaga

SEQ ID NO: 1757 - RNA, 23 nt, Artificial Sequence
  Description of Artificial Sequence: Synthetic oligonucleotide
aagauaccauaugcucuggaaaa

SEQ ID NO: 1758 - RNA, 23 nt, Artificial Sequence
  Description of Artificial Sequence: Synthetic oligonucleotide
aaaaagauaccauaugcucugga

SEQ ID NO: 1759 - RNA, 23 nt, Artificial Sequence
  Description of Artificial Sequence: Synthetic oligonucleotide
aaguugcaaaagauaccauaugc

SEQ ID NO: 1760 - RNA, 23 nt, Artificial Sequence
  Description of Artificial Sequence: Synthetic oligonucleotide
aucaguugcaaaagauaccauau

SEQ ID NO: 1761 - RNA, 23 nt, Artificial Sequence
  Description of Artificial Sequence: Synthetic oligonucleotide
auucaguugcaaaagauaccaua

SEQ ID NO: 1762 - RNA, 23 nt, Artificial Sequence
  Description of Artificial Sequence: Synthetic oligonucleotide
aguuucaguugcaaaagauacca

SEQ ID NO: 1763 - RNA, 23 nt, Artificial Sequence
  Description of Artificial Sequence: Synthetic oligonucleotide
accauugguuucaguugcaaaag

SEQ ID NO: 1764 - RNA, 23 nt, Artificial Sequence
  Description of Artificial Sequence: Synthetic oligonucleotide
aucaccauugguuucaguugcaa

SEQ ID NO: 1765 - RNA, 23 nt, Artificial Sequence
  Description of Artificial Sequence: Synthetic oligonucleotide
acagaaacaucugcaaaaucugu

SEQ ID NO: 1766 - RNA, 23 nt, Artificial Sequence
  Description of Artificial Sequence: Synthetic oligonucleotide
aacucagaaacaucugcaaaauc

SEQ ID NO: 1767 - RNA, 23 nt, Artificial Sequence
  Description of Artificial Sequence: Synthetic oligonucleotide
agcuugaacucagaaacaucugc

SEQ ID NO: 1768 - RNA, 23 nt, Artificial Sequence
  Description of Artificial Sequence: Synthetic oligonucleotide
augugcuugaacucagaaacauc

SEQ ID NO: 1769 - RNA, 23 nt, Artificial Sequence
  Description of Artificial Sequence: Synthetic oligonucleotide
auuucaggauaugugcuugaacu

SEQ ID NO: 1770 - RNA, 23 nt, Artificial Sequence
  Description of Artificial Sequence: Synthetic oligonucleotide
agaauuucaggauaugugcuuga

SEQ ID NO: 1771 - RNA, 23 nt, Artificial Sequence
  Description of Artificial Sequence: Synthetic oligonucleotide
aaaccaugaauuucaggauaugu

SEQ ID NO: 1772 - RNA, 23 nt, Artificial Sequence
  Description of Artificial Sequence: Synthetic oligonucleotide
agaaaccaugaauuucaggauau

SEQ ID NO: 1773 - RNA, 23 nt, Artificial Sequence
  Description of Artificial Sequence: Synthetic oligonucleotide
aagaaaccaugaauuucaggaua

SEQ ID NO: 1774 - RNA, 23 nt, Artificial Sequence
  Description of Artificial Sequence: Synthetic oligonucleotide
auaagaaaccaugaauuucagga

SEQ ID NO: 1775 - RNA, 23 nt, Artificial Sequence
  Description of Artificial Sequence: Synthetic oligonucleotide
acgcauguaagaaaccaugaauu

SEQ ID NO: 1776 - RNA, 23 nt, Artificial Sequence
  Description of Artificial Sequence: Synthetic oligonucleotide
auuucgcauguaagaaaccauga

SEQ ID NO: 1777 - RNA, 23 nt, Artificial Sequence
  Description of Artificial Sequence: Synthetic oligonucleotide
aaaaaacugcaaaugccgcgguu

SEQ ID NO: 1778 - RNA, 23 nt, Artificial Sequence
  Description of Artificial Sequence: Synthetic oligonucleotide
acugaaaaacugcaaaugccgcg

SEQ ID NO: 1779 - RNA, 23 nt, Artificial Sequence
  Description of Artificial Sequence: Synthetic oligonucleotide
aaauucgcugaaaaacugcaaau

SEQ ID NO: 1780 - RNA, 23 nt, Artificial Sequence
  Description of Artificial Sequence: Synthetic oligonucleotide
acaaauucgcugaaaaacugcaa

SEQ ID NO: 1781 - RNA, 23 nt, Artificial Sequence
  Description of Artificial Sequence: Synthetic oligonucleotide
accaaauucgcugaaaaacugca

SEQ ID NO: 1782 - RNA, 23 nt, Artificial Sequence
  Description of Artificial Sequence: Synthetic oligonucleotide
augccaaauucgcugaaaaacug

SEQ ID NO: 1783 - RNA, 23 nt, Artificial Sequence
  Description of Artificial Sequence: Synthetic oligonucleotide
acacuauugccaaauucgcugaa

SEQ ID NO: 1784 - RNA, 23 nt, Artificial Sequence
  Description of Artificial Sequence: Synthetic oligonucleotide
auaucacuauugccaaauucgcu

SEQ ID NO: 1785 - RNA, 23 nt, Artificial Sequence
  Description of Artificial Sequence: Synthetic oligonucleotide
aaaauaucacuauugccaaauuc

SEQ ID NO: 1786 - RNA, 23 nt, Artificial Sequence
  Description of Artificial Sequence: Synthetic oligonucleotide
aacacauaaauaucacuauugcc

SEQ ID NO: 1787 - RNA, 23 nt, Artificial Sequence
  Description of Artificial Sequence: Synthetic oligonucleotide
augacacauaaauaucacuauug

SEQ ID NO: 1788 - RNA, 23 nt, Artificial Sequence
  Description of Artificial Sequence: Synthetic oligonucleotide
agugacacauaaauaucacuauu

SEQ ID NO: 1789 - RNA, 23 nt, Artificial Sequence
  Description of Artificial Sequence: Synthetic oligonucleotide
acagugacacauaaauaucacua

SEQ ID NO: 1790 - RNA, 23 nt, Artificial Sequence
  Description of Artificial Sequence: Synthetic oligonucleotide
agccugccagugacacauaaaua

SEQ ID NO: 1791 - RNA, 23 nt, Artificial Sequence
  Description of Artificial Sequence: Synthetic oligonucleotide
auuugccugccagugacacauaa

SEQ ID NO: 1792 - RNA, 23 nt, Artificial Sequence
  Description of Artificial Sequence: Synthetic oligonucleotide
aauaguuagucggugcuccaugu

SEQ ID NO: 1793 - RNA, 23 nt, Artificial Sequence
  Description of Artificial Sequence: Synthetic oligonucleotide
accauaguuagucggugcuccau

SEQ ID NO: 1794 - RNA, 23 nt, Artificial Sequence
  Description of Artificial Sequence: Synthetic oligonucleotide
auccauaguuagucggugcucca

SEQ ID NO: 1795 - RNA, 23 nt, Artificial Sequence
  Description of Artificial Sequence: Synthetic oligonucleotide
aaauccauaguuagucggugcuc

SEQ ID NO: 1796 - RNA, 23 nt, Artificial Sequence
  Description of Artificial Sequence: Synthetic oligonucleotide
aaagcagaauccauaguuagucg

SEQ ID NO: 1797 - RNA, 23 nt, Artificial Sequence
  Description of Artificial Sequence: Synthetic oligonucleotide
auuaaagcagaauccauaguuag

SEQ ID NO: 1798 - RNA, 23 nt, Artificial Sequence
  Description of Artificial Sequence: Synthetic oligonucleotide
aauaauucugguacagcugcaug

SEQ ID NO: 1799 - RNA, 23 nt, Artificial Sequence
  Description of Artificial Sequence: Synthetic oligonucleotide
acauauaauucugguacagcugc

SEQ ID NO: 1800 - RNA, 23 nt, Artificial Sequence
  Description of Artificial Sequence: Synthetic oligonucleotide
auggaugcauauaauucugguac

SEQ ID NO: 1801 - RNA, 23 nt, Artificial Sequence
  Description of Artificial Sequence: Synthetic oligonucleotide
aauauggaugcauauaauucugg

SEQ ID NO: 1802 - RNA, 23 nt, Artificial Sequence
  Description of Artificial Sequence: Synthetic oligonucleotide
aaugcucugugaacugcagccac

SEQ ID NO: 1803 - RNA, 23 nt, Artificial Sequence
  Description of Artificial Sequence: Synthetic oligonucleotide
agauaugcucugugaacugcagc

SEQ ID NO: 1804 - RNA, 23 nt, Artificial Sequence
  Description of Artificial Sequence: Synthetic oligonucleotide
aauaggugauaugcucugugaac

SEQ ID NO: 1805 - RNA, 23 nt, Artificial Sequence
  Description of Artificial Sequence: Synthetic oligonucleotide
acucauaggugauaugcucugug

SEQ ID NO: 1806 - RNA, 23 nt, Artificial Sequence
  Description of Artificial Sequence: Synthetic oligonucleotide
augauauacuucucauaggugau

SEQ ID NO: 1807 - RNA, 23 nt, Artificial Sequence
  Description of Artificial Sequence: Synthetic oligonucleotide
acucugauauacuucucauaggu

SEQ ID NO: 1808 - RNA, 23 nt, Artificial Sequence
  Description of Artificial Sequence: Synthetic oligonucleotide
aggaauucucugauauacuucuc

SEQ ID NO: 1809 - RNA, 23 nt, Artificial Sequence
  Description of Artificial Sequence: Synthetic oligonucleotide
aagggaauucucugauauacuuc

SEQ ID NO: 1810 - RNA, 23 nt, Artificial Sequence
  Description of Artificial Sequence: Synthetic oligonucleotide
acagggaauucucugauauacuu

SEQ ID NO: 1811 - RNA, 23 nt, Artificial Sequence
  Description of Artificial Sequence: Synthetic oligonucleotide
aaccagggaauucucugauauac

SEQ ID NO: 1812 - RNA, 23 nt, Artificial Sequence
  Description of Artificial Sequence: Synthetic oligonucleotide
aauugcuaccagggaauucucug

SEQ ID NO: 1813 - RNA, 23 nt, Artificial Sequence
  Description of Artificial Sequence: Synthetic oligonucleotide
accauugcuaccagggaauucuc

SEQ ID NO: 1814 - RNA, 23 nt, Artificial Sequence
  Description of Artificial Sequence: Synthetic oligonucleotide
auccauugcuaccagggaauucu

SEQ ID NO: 1815 - RNA, 23 nt, Artificial Sequence
  Description of Artificial Sequence: Synthetic oligonucleotide
aaguccauugcuaccagggaauu

SEQ ID NO: 1816 - RNA, 23 nt, Artificial Sequence
  Description of Artificial Sequence: Synthetic oligonucleotide
acugagaaguccauugcuaccag

SEQ ID NO: 1817 - RNA, 23 nt, Artificial Sequence
  Description of Artificial Sequence: Synthetic oligonucleotide
aggccugagaaguccauugcuac

SEQ ID NO: 1818 - RNA, 23 nt, Artificial Sequence
  Description of Artificial Sequence: Synthetic oligonucleotide
auuguggugaaaccauggcuggg

SEQ ID NO: 1819 - RNA, 23 nt, Artificial Sequence
  Description of Artificial Sequence: Synthetic oligonucleotide
aauuuuguggugaaaccauggcu

SEQ ID NO: 1820 - RNA, 23 nt, Artificial Sequence
  Description of Artificial Sequence: Synthetic oligonucleotide
acuagaaauuuuguggugaaacc

SEQ ID NO: 1821 - RNA, 23 nt, Artificial Sequence
  Description of Artificial Sequence: Synthetic oligonucleotide
aucucuagaaauuuuguggugaa

SEQ ID NO: 1822 - RNA, 23 nt, Artificial Sequence
  Description of Artificial Sequence: Synthetic oligonucleotide
aaccaagaaaacuccauccacaa

SEQ ID NO: 1823 - RNA, 23 nt, Artificial Sequence
  Description of Artificial Sequence: Synthetic oligonucleotide
acguaccaagaaaacuccaucca

SEQ ID NO: 1824 - RNA, 23 nt, Artificial Sequence
  Description of Artificial Sequence: Synthetic oligonucleotide
acuaucccguaccaagaaaacuc

SEQ ID NO: 1825 - RNA, 23 nt, Artificial Sequence
  Description of Artificial Sequence: Synthetic oligonucleotide
augacuaucccguaccaagaaaa

SEQ ID NO: 1826 - RNA, 23 nt, Artificial Sequence
  Description of Artificial Sequence: Synthetic oligonucleotide
aucauugacaguacgaaaguuuu

SEQ ID NO: 1827 - RNA, 23 nt, Artificial Sequence
  Description of Artificial Sequence: Synthetic oligonucleotide
aacucauugacaguacgaaaguu

SEQ ID NO: 1828 - RNA, 23 nt, Artificial Sequence
  Description of Artificial Sequence: Synthetic oligonucleotide
agacucauugacaguacgaaagu

SEQ ID NO: 1829 - RNA, 23 nt, Artificial Sequence
  Description of Artificial Sequence: Synthetic oligonucleotide
aaugacucauugacaguacgaaa

SEQ ID NO: 1830 - RNA, 23 nt, Artificial Sequence
  Description of Artificial Sequence: Synthetic oligonucleotide
auuguccaugacucauugacagu

SEQ ID NO: 1831 - RNA, 23 nt, Artificial Sequence
  Description of Artificial Sequence: Synthetic oligonucleotide
agaacuccaccagcuguauuaga

SEQ ID NO: 1832 - RNA, 23 nt, Artificial Sequence
  Description of Artificial Sequence: Synthetic oligonucleotide
aauagaacuccaccagcuguauu

SEQ ID NO: 1833 - RNA, 23 nt, Artificial Sequence
  Description of Artificial Sequence: Synthetic oligonucleotide
agaguugauagaacuccaccagc

SEQ ID NO: 1834 - RNA, 23 nt, Artificial Sequence
  Description of Artificial Sequence: Synthetic oligonucleotide
aauugaguugauagaacuccacc

SEQ ID NO: 1835 - RNA, 23 nt, Artificial Sequence
  Description of Artificial Sequence: Synthetic oligonucleotide
acuugcaaggaagaacgcccuua

SEQ ID NO: 1836 - RNA, 23 nt, Artificial Sequence
  Description of Artificial Sequence: Synthetic oligonucleotide
acaacuugcaaggaagaacgccc

SEQ ID NO: 1837 - RNA, 23 nt, Artificial Sequence
  Description of Artificial Sequence: Synthetic oligonucleotide
aauguuucaacuugcaaggaaga

SEQ ID NO: 1838 - RNA, 23 nt, Artificial Sequence
  Description of Artificial Sequence: Synthetic oligonucleotide
aauaauguuucaacuugcaagga

SEQ ID NO: 1839 - RNA, 23 nt, Artificial Sequence
  Description of Artificial Sequence: Synthetic oligonucleotide
auucuggcuugucuagagagcaa

SEQ ID NO: 1840 - RNA, 23 nt, Artificial Sequence
  Description of Artificial Sequence: Synthetic oligonucleotide
acacuucuggcuugucuagagag

SEQ ID NO: 1841 - RNA, 23 nt, Artificial Sequence
  Description of Artificial Sequence: Synthetic oligonucleotide
aauaagucacuucuggcuugucu

SEQ ID NO: 1842 - RNA, 23 nt, Artificial Sequence
  Description of Artificial Sequence: Synthetic oligonucleotide
auuaauaagucacuucuggcuug

SEQ ID NO: 1843 - RNA, 23 nt, Artificial Sequence
  Description of Artificial Sequence: Synthetic oligonucleotide
acaugguaauguuuucgcccuua

SEQ ID NO: 1844 - RNA, 23 nt, Artificial Sequence
  Description of Artificial Sequence: Synthetic oligonucleotide
aucacaugguaauguuuucgccc

SEQ ID NO: 1845 - RNA, 23 nt, Artificial Sequence
  Description of Artificial Sequence: Synthetic oligonucleotide
auucuuuucacaugguaauguuu

SEQ ID NO: 1846 - RNA, 23 nt, Artificial Sequence
  Description of Artificial Sequence: Synthetic oligonucleotide
acauucuuuucacaugguaaugu

SEQ ID NO: 1847 - RNA, 23 nt, Artificial Sequence
  Description of Artificial Sequence: Synthetic oligonucleotide
aacauucuuuucacaugguaaug

SEQ ID NO: 1848 - RNA, 23 nt, Artificial Sequence
  Description of Artificial Sequence: Synthetic oligonucleotide
aauacauucuuuucacaugguaa

SEQ ID NO: 1849 - RNA, 23 nt, Artificial Sequence
  Description of Artificial Sequence: Synthetic oligonucleotide
aggugaaauacauucuuuucaca

SEQ ID NO: 1850 - RNA, 23 nt, Artificial Sequence
  Description of Artificial Sequence: Synthetic oligonucleotide
agcaggugaaauacauucuuuuc

SEQ ID NO: 1851 - RNA, 23 nt, Artificial Sequence
  Description of Artificial Sequence: Synthetic oligonucleotide
auccaagucuuugcuuauuugca

SEQ ID NO: 1852 - RNA, 23 nt, Artificial Sequence
  Description of Artificial Sequence: Synthetic oligonucleotide
acaauccaagucuuugcuuauuu

SEQ ID NO: 1853 - RNA, 23 nt, Artificial Sequence
  Description of Artificial Sequence: Synthetic oligonucleotide
auaaagucaauccaagucuuugc

SEQ ID NO: 1854 - RNA, 23 nt, Artificial Sequence
  Description of Artificial Sequence: Synthetic oligonucleotide
aauguaaagucaauccaagucuu

SEQ ID NO: 1855 - RNA, 23 nt, Homo sapiens
aggugauuaaaguauacagugaa

SEQ ID NO: 1856 - RNA, 23 nt, Homo sapiens
ugauuaaaguauacagugaagau

SEQ ID NO: 1857 - RNA, 23 nt, Homo sapiens
aaguauacagugaagaugaaacc

SEQ ID NO: 1858 - RNA, 23 nt, Homo sapiens
uauacagugaagaugaaaccagc

SEQ ID NO: 1859 - RNA, 23 nt, Homo sapiens
ccucacauagguguagaaagaac

SEQ ID NO: 1860 - RNA, 23 nt, Homo sapiens
cacauagguguagaaagaacaau

SEQ ID NO: 1861 - RNA, 23 nt, Homo sapiens
gguguagaaagaacaauagaaga

SEQ ID NO: 1862 - RNA, 23 nt, Homo sapiens
guagaaagaacaauagaagacca

SEQ ID NO: 1863 - RNA, 23 nt, Homo sapiens
cacgaacuggugauugaagugcu

SEQ ID NO: 1864 - RNA, 23 nt, Homo sapiens
gaacuggugauugaagugcuauc

SEQ ID NO: 1865 - RNA, 23 nt, Homo sapiens
gugauugaagugcuauccaacug

SEQ ID NO: 1866 - RNA, 23 nt, Homo sapiens
auagaagaagaaaacaaacuaua

SEQ ID NO: 1867 - RNA, 23 nt, Homo sapiens
gaagaagaaaacaaacuauacuu

SEQ ID NO: 1868 - RNA, 23 nt, Homo sapiens
uuaugccaaauaugaguucuuua

SEQ ID NO: 1869 - RNA, 23 nt, Homo sapiens
ucuuuaaaaacccaauguauuuu

SEQ ID NO: 1870 - RNA, 23 nt, Homo sapiens
uuuuccagagcauaugguaucuu

SEQ ID NO: 1871 - RNA, 23 nt, Homo sapiens
uccagagcauaugguaucuuuug

SEQ ID NO: 1872 - RNA, 23 nt, Homo sapiens
gcauaugguaucuuuugcaacug

SEQ ID NO: 1873 - RNA, 23 nt, Homo sapiens
auaugguaucuuuugcaacugaa

SEQ ID NO: 1874 - RNA, 23 nt, Homo sapiens
uaugguaucuuuugcaacugaaa

SEQ ID NO: 1875 - RNA, 23 nt, Homo sapiens
ugguaucuuuugcaacugaaacc

SEQ ID NO: 1876 - RNA, 23 nt, Homo sapiens
cuuuugcaacugaaaccaauggu

SEQ ID NO: 1877 - RNA, 23 nt, Homo sapiens
uugcaacugaaaccaauggugaa

SEQ ID NO: 1878 - RNA, 23 nt, Homo sapiens
acagauuuugcagauguuucuga

SEQ ID NO: 1879 - RNA, 23 nt, Homo sapiens
gauuuugcagauguuucugaguu

SEQ ID NO: 1880 - RNA, 23 nt, Homo sapiens
gcagauguuucugaguucaagca

SEQ ID NO: 1881 - RNA, 23 nt, Homo sapiens
gauguuucugaguucaagcacau

SEQ ID NO: 1882 - RNA, 23 nt, Homo sapiens
aguucaagcacauauccugaaau

SEQ ID NO: 1883 - RNA, 23 nt, Homo sapiens
ucaagcacauauccugaaauuca

SEQ ID NO: 1884 - RNA, 23 nt, Homo sapiens
acauauccugaaauucaugguuu

SEQ ID NO: 1885 - RNA, 23 nt, Homo sapiens
auauccugaaauucaugguuucu

SEQ ID NO: 1886 - RNA, 23 nt, Homo sapiens
uauccugaaauucaugguuucuu

SEQ ID NO: 1887 - RNA, 23 nt, Homo sapiens
uccugaaauucaugguuucuuac

SEQ ID NO: 1888 - RNA, 23 nt, Homo sapiens
aauucaugguuucuuacaugcga

SEQ ID NO: 1889 - RNA, 23 nt, Homo sapiens
ucaugguuucuuacaugcgaaag

SEQ ID NO: 1890 - RNA, 23 nt, Homo sapiens
aaccgcggcauuugcaguuuuuc

SEQ ID NO: 1891 - RNA, 23 nt, Homo sapiens
cgcggcauuugcaguuuuucagc

SEQ ID NO: 1892 - RNA, 23 nt, Homo sapiens
auuugcaguuuuucagcgaauuu

SEQ ID NO: 1893 - RNA, 23 nt, Homo sapiens
uugcaguuuuucagcgaauuugg

SEQ ID NO: 1894 - RNA, 23 nt, Homo sapiens
ugcaguuuuucagcgaauuuggc

SEQ ID NO: 1895 - RNA, 23 nt, Homo sapiens
caguuuuucagcgaauuuggcaa

SEQ ID NO: 1896 - RNA, 23 nt, Homo sapiens
uucagcgaauuuggcaauaguga

SEQ ID NO: 1897 - RNA, 23 nt, Homo sapiens
agcgaauuuggcaauagugauau

SEQ ID NO: 1898 - RNA, 23 nt, Homo sapiens
gaauuuggcaauagugauauuua

SEQ ID NO: 1899 - RNA, 23 nt, Homo sapiens
ggcaauagugauauuuauguguc

SEQ ID NO: 1900 - RNA, 23 nt, Homo sapiens
caauagugauauuuaugugucac

SEQ ID NO: 1901 - RNA, 23 nt, Homo sapiens
aauagugauauuuaugugucacu

SEQ ID NO: 1902 - RNA, 23 nt, Homo sapiens
uagugauauuuaugugucacugg

SEQ ID NO: 1903 - RNA, 23 nt, Homo sapiens
uauuuaugugucacuggcaggca

SEQ ID NO: 1904 - RNA, 23 nt, Homo sapiens
uuaugugucacuggcaggcaaaa

SEQ ID NO: 1905 - RNA, 23 nt, Homo sapiens
acauggagcaccgacuaacuaug

SEQ ID NO: 1906 - RNA, 23 nt, Homo sapiens
auggagcaccgacuaacuaugga

SEQ ID NO: 1907 - RNA, 23 nt, Homo sapiens
uggagcaccgacuaacuauggau

SEQ ID NO: 1908 - RNA, 23 nt, Homo sapiens
gagcaccgacuaacuauggauuc

SEQ ID NO: 1909 - RNA, 23 nt, Homo sapiens
cgacuaacuauggauucugcuuu

SEQ ID NO: 1910 - RNA, 23 nt, Homo sapiens
cuaacuauggauucugcuuuaag

SEQ ID NO: 1911 - RNA, 23 nt, Homo sapiens
caugcagcuguaccagaauuaua

SEQ ID NO: 1912 - RNA, 23 nt, Homo sapiens
gcagcuguaccagaauuauaugc

SEQ ID NO: 1913 - RNA, 23 nt, Homo sapiens
guaccagaauuauaugcauccau

SEQ ID NO: 1914 - RNA, 23 nt, Homo sapiens
ccagaauuauaugcauccauauc

SEQ ID NO: 1915 - RNA, 23 nt, Homo sapiens
guggcugcaguucacagagcaua

SEQ ID NO: 1916 - RNA, 23 nt, Homo sapiens
gcugcaguucacagagcauauca

SEQ ID NO: 1917 - RNA, 23 nt, Homo sapiens
guucacagagcauaucaccuaug

SEQ ID NO: 1918 - RNA, 23 nt, Homo sapiens
cacagagcauaucaccuaugaga

SEQ ID NO: 1919 - RNA, 23 nt, Homo sapiens
aucaccuaugagaaguauaucag

SEQ ID NO: 1920 - RNA, 23 nt, Homo sapiens
accuaugagaaguauaucagaga

SEQ ID NO: 1921 - RNA, 23 nt, Homo sapiens
gagaaguauaucagagaauuccc

SEQ ID NO: 1922 - RNA, 23 nt, Homo sapiens
gaaguauaucagagaauucccug

SEQ ID NO: 1923 - RNA, 23 nt, Homo sapiens
aaguauaucagagaauucccugg

SEQ ID NO: 1924 - RNA, 23 nt, Homo sapiens
guauaucagagaauucccuggua

SEQ ID NO: 1925 - RNA, 23 nt, Homo sapiens
cagagaauucccugguagcaaug

SEQ ID NO: 1926 - RNA, 23 nt, Homo sapiens
gagaauucccugguagcaaugga

SEQ ID NO: 1927 - RNA, 23 nt, Homo sapiens
agaauucccugguagcaauggac

SEQ ID NO: 1928 - RNA, 23 nt, Homo sapiens
aauucccugguagcaauggacuu

SEQ ID NO: 1929 - RNA, 23 nt, Homo sapiens
cugguagcaauggacuucucagg

SEQ ID NO: 1930 - RNA, 23 nt, Homo sapiens
guagcaauggacuucucaggcca

SEQ ID NO: 1931 - RNA, 23 nt, Homo sapiens
cccagccaugguuucaccacaaa

SEQ ID NO: 1932 - RNA, 23 nt, Homo sapiens
agccaugguuucaccacaaaauu

SEQ ID NO: 1933 - RNA, 23 nt, Homo sapiens
gguuucaccacaaaauuucuaga

SEQ ID NO: 1934 - RNA, 23 nt, Homo sapiens
uucaccacaaaauuucuagagau

SEQ ID NO: 1935 - RNA, 23 nt, Homo sapiens
uuguggauggaguuuucuuggua

SEQ ID NO: 1936 - RNA, 23 nt, Homo sapiens
uggauggaguuuucuugguacgg

SEQ ID NO: 1937 - RNA, 23 nt, Homo sapiens
gaguuuucuugguacgggauagu

SEQ ID NO: 1938 - RNA, 23 nt, Homo sapiens
uuuucuugguacgggauagucag

SEQ ID NO: 1939 - RNA, 23 nt, Homo sapiens
aaaacuuucguacugucaaugag

SEQ ID NO: 1940 - RNA, 23 nt, Homo sapiens
aacuuucguacugucaaugaguc

SEQ ID NO: 1941 - RNA, 23 nt, Homo sapiens
acuuucguacugucaaugaguca

SEQ ID NO: 1942 - RNA, 23 nt, Homo sapiens
uuucguacugucaaugagucaug

SEQ ID NO: 1943 - RNA, 23 nt, Homo sapiens
acugucaaugagucauggacaaa

SEQ ID NO: 1944 - RNA, 23 nt, Homo sapiens
ucuaauacagcugguggaguucu

SEQ ID NO: 1945 - RNA, 23 nt, Homo sapiens
aauacagcugguggaguucuauc

SEQ ID NO: 1946 - RNA, 23 nt, Homo sapiens
gcugguggaguucuaucaacuca

SEQ ID NO: 1947 - RNA, 23 nt, Homo sapiens
gguggaguucuaucaacucaaua

SEQ ID NO: 1948 - RNA, 23 nt, Homo sapiens
uaagggcguucuuccuugcaagu

SEQ ID NO: 1949 - RNA, 23 nt, Homo sapiens
gggcguucuuccuugcaaguuga

SEQ ID NO: 1950 - RNA, 23 nt, Homo sapiens
ucuuccuugcaaguugaaacauu

SEQ ID NO: 1951 - RNA, 23 nt, Homo sapiens
uccuugcaaguugaaacauuauu

SEQ ID NO: 1952 - RNA, 23 nt, Homo sapiens
uugcucucuagacaagccagaag

SEQ ID NO: 1953 - RNA, 23 nt, Homo sapiens
cucucuagacaagccagaaguga

SEQ ID NO: 1954 - RNA, 23 nt, Homo sapiens
agacaagccagaagugacuuauu

SEQ ID NO: 1955 - RNA, 23 nt, Homo sapiens
caagccagaagugacuuauuaaa

SEQ ID NO: 1956 - RNA, 23 nt, Homo sapiens
uaagggcgaaaacauuaccaugu

SEQ ID NO: 1957 - RNA, 23 nt, Homo sapiens
gggcgaaaacauuaccaugugaa

SEQ ID NO: 1958 - RNA, 23 nt, Homo sapiens
aaacauuaccaugugaaaagaau

SEQ ID NO: 1959 - RNA, 23 nt, Homo sapiens
acauuaccaugugaaaagaaugu

SEQ ID NO: 1960 - RNA, 23 nt, Homo sapiens
cauuaccaugugaaaagaaugua

SEQ ID NO: 1961 - RNA, 23 nt, Homo sapiens
uuaccaugugaaaagaauguauu

SEQ ID NO: 1962 - RNA, 23 nt, Homo sapiens
ugugaaaagaauguauuucaccu

SEQ ID NO: 1963 - RNA, 23 nt, Homo sapiens
gaaaagaauguauuucaccugca

SEQ ID NO: 1964 - RNA, 23 nt, Homo sapiens
ugcaaauaagcaaagacuuggau

SEQ ID NO: 1965 - RNA, 23 nt, Homo sapiens
aaauaagcaaagacuuggauuga

SEQ ID NO: 1966 - RNA, 23 nt, Homo sapiens
gcaaagacuuggauugacuuuac

SEQ ID NO: 1967 - RNA, 23 nt, Homo sapiens
aagacuuggauugacuuuacauu

SEQ ID NO: 1968 - RNA, 21 nt, Artificial Sequence
  Description of Artificial Sequence: Synthetic oligonucleotide
gccuucaggaggaagaccaga

SEQ ID NO: 1969 - RNA, 21 nt, Artificial Sequence
  Description of Artificial Sequence: Synthetic oligonucleotide
gucuuuagugaagaugggaca

SEQ ID NO: 1970 - RNA, 21 nt, Artificial Sequence
  Description of Artificial Sequence: Synthetic oligonucleotide
gguuuacaaaagucacuguga

SEQ ID NO: 1971 - RNA, 21 nt, Artificial Sequence
  Description of Artificial Sequence: Synthetic oligonucleotide
aaaagucacuguguggaugaa

SEQ ID NO: 1972 - RNA, 21 nt, Artificial Sequence
  Description of Artificial Sequence: Synthetic oligonucleotide
acuguguggaugacaacagca

SEQ ID NO: 1973 - RNA, 21 nt, Artificial Sequence
  Description of Artificial Sequence: Synthetic oligonucleotide
acccagacaccugcagcugca

SEQ ID NO: 1974 - RNA, 21 nt, Artificial Sequence
  Description of Artificial Sequence: Synthetic oligonucleotide
caagguggagcagacaccuca

SEQ ID NO: 1975 - RNA, 21 nt, Artificial Sequence
  Description of Artificial Sequence: Synthetic oligonucleotide
gagcagacaccucgcagucaa

SEQ ID NO: 1976 - RNA, 21 nt, Artificial Sequence
  Description of Artificial Sequence: Synthetic oligonucleotide
caccucgcagucaacaagaca

SEQ ID NO: 1977 - RNA, 21 nt, Artificial Sequence
  Description of Artificial Sequence: Synthetic oligonucleotide
cagucaacaagacccggcaga

SEQ ID NO: 1978 - RNA, 21 nt, Artificial Sequence
  Description of Artificial Sequence: Synthetic oligonucleotide
caagacccggcaggaccagga

SEQ ID NO: 1979 - RNA, 21 nt, Artificial Sequence
  Description of Artificial Sequence: Synthetic oligonucleotide
cgcacagucugaccgacuuga

SEQ ID NO: 1980 - RNA, 21 nt, Artificial Sequence
  Description of Artificial Sequence: Synthetic oligonucleotide
ucugaccgacuugcgaaucaa

SEQ ID NO: 1981 - RNA, 21 nt, Artificial Sequence
  Description of Artificial Sequence: Synthetic oligonucleotide
gaugauguggaccuggaagca

SEQ ID NO: 1982 - RNA, 21 nt, Artificial Sequence
  Description of Artificial Sequence: Synthetic oligonucleotide
uggaccuggaagcccugguga

SEQ ID NO: 1983 - RNA, 21 nt, Artificial Sequence
  Description of Artificial Sequence: Synthetic oligonucleotide
ggaagcccuggugaacgauaa

SEQ ID NO: 1984 - RNA, 21 nt, Artificial Sequence
  Description of Artificial Sequence: Synthetic oligonucleotide
cuggugaacgauaugaaugca

SEQ ID NO: 1985 - RNA, 21 nt, Artificial Sequence
  Description of Artificial Sequence: Synthetic oligonucleotide
acgauaugaaugcaucccuga

SEQ ID NO: 1986 - RNA, 21 nt, Artificial Sequence
  Description of Artificial Sequence: Synthetic oligonucleotide
gaaugcaucccuggagagcca

SEQ ID NO: 1987 - RNA, 21 nt, Artificial Sequence
  Description of Artificial Sequence: Synthetic oligonucleotide
ucccuggagagccuguacuca

SEQ ID NO: 1988 - RNA, 21 nt, Artificial Sequence
  Description of Artificial Sequence: Synthetic oligonucleotide
gagccuguacucggccugcaa

SEQ ID NO: 1989 - RNA, 21 nt, Artificial Sequence
  Description of Artificial Sequence: Synthetic oligonucleotide
uacucggccugcagcaugcaa

SEQ ID NO: 1990 - RNA, 21 nt, Artificial Sequence
  Description of Artificial Sequence: Synthetic oligonucleotide
ccugcagcaugcagucagaca

SEQ ID NO: 1991 - RNA, 21 nt, Artificial Sequence
  Description of Artificial Sequence: Synthetic oligonucleotide
caugcagucagacacggugca

SEQ ID NO: 1992 - RNA, 21 nt, Artificial Sequence
  Description of Artificial Sequence: Synthetic oligonucleotide
cuccugcagaauggccagcaa

SEQ ID NO: 1993 - RNA, 21 nt, Artificial Sequence
  Description of Artificial Sequence: Synthetic oligonucleotide
gaauggccagcaugcccgcaa

SEQ ID NO: 1994 - RNA, 21 nt, Artificial Sequence
  Description of Artificial Sequence: Synthetic oligonucleotide
ucaggcccuccucgguccaua

SEQ ID NO: 1995 - RNA, 21 nt, Artificial Sequence
  Description of Artificial Sequence: Synthetic oligonucleotide
ccucgguccauccagccacaa

SEQ ID NO: 1996 - RNA, 21 nt, Artificial Sequence
  Description of Artificial Sequence: Synthetic oligonucleotide
ccauccagccacaggugucca

SEQ ID NO: 1997 - RNA, 21 nt, Artificial Sequence
  Description of Artificial Sequence: Synthetic oligonucleotide
cgcucccagccugugcacaua

SEQ ID NO: 1998 - RNA, 21 nt, Artificial Sequence
  Description of Artificial Sequence: Synthetic oligonucleotide
agccugugcacauccucgcua

SEQ ID NO: 1999 - RNA, 21 nt, Artificial Sequence
  Description of Artificial Sequence: Synthetic oligonucleotide
ggaggaagaccagcaguuuaa

SEQ ID NO: 2000 - RNA, 21 nt, Artificial Sequence
  Description of Artificial Sequence: Synthetic oligonucleotide
gaccagcaguuuagaaccuca

SEQ ID NO: 2001 - RNA, 21 nt, Artificial Sequence
  Description of Artificial Sequence: Synthetic oligonucleotide
aguuuagaaccucaucucuga

SEQ ID NO: 2002 - RNA, 21 nt, Artificial Sequence
  Description of Artificial Sequence: Synthetic oligonucleotide
aaccucaucucugccggccaa

SEQ ID NO: 2003 - RNA, 21 nt, Artificial Sequence
  Description of Artificial Sequence: Synthetic oligonucleotide
caauccuuuuccugaacucua

SEQ ID NO: 2004 - RNA, 21 nt, Artificial Sequence
  Description of Artificial Sequence: Synthetic oligonucleotide
uuuccugaacucuguggccca

SEQ ID NO: 2005 - RNA, 21 nt, Artificial Sequence
  Description of Artificial Sequence: Synthetic oligonucleotide
aacucuguggcccugggagca

SEQ ID NO: 2006 - RNA, 21 nt, Artificial Sequence
  Description of Artificial Sequence: Synthetic oligonucleotide
ugugcucacgccggguucuua

SEQ ID NO: 2007 - RNA, 21 nt, Artificial Sequence
  Description of Artificial Sequence: Synthetic oligonucleotide
acgccggguucuuuaccucca

SEQ ID NO: 2008 - RNA, 21 nt, Artificial Sequence
  Description of Artificial Sequence: Synthetic oligonucleotide
guucuuuaccuccgagccaga

SEQ ID NO: 2009 - RNA, 21 nt, Artificial Sequence
  Description of Artificial Sequence: Synthetic oligonucleotide
agcaaagugguggagauucua

SEQ ID NO: 2010 - RNA, 21 nt, Artificial Sequence
  Description of Artificial Sequence: Synthetic oligonucleotide
uguuaaagucuuuagugaaga

SEQ ID NO: 2011 - RNA, 21 nt, Artificial Sequence
  Description of Artificial Sequence: Synthetic oligonucleotide
gugaagaugggacaagcaaaa

SEQ ID NO: 2012 - RNA, 21 nt, Artificial Sequence
  Description of Artificial Sequence: Synthetic oligonucleotide
ugggacaagcaaaguggugga

SEQ ID NO: 2013 - RNA, 21 nt, Artificial Sequence
  Description of Artificial Sequence: Synthetic oligonucleotide
ugguggagauucuagcagaca

SEQ ID NO: 2014 - RNA, 21 nt, Artificial Sequence
  Description of Artificial Sequence: Synthetic oligonucleotide
gauucuagcagacaugacaga

SEQ ID NO: 2015 - RNA, 21 nt, Artificial Sequence
  Description of Artificial Sequence: Synthetic oligonucleotide
gcagacaugacagccagagaa

SEQ ID NO: 2016 - RNA, 21 nt, Artificial Sequence
  Description of Artificial Sequence: Synthetic oligonucleotide
ugacagccagagaccugugca

SEQ ID NO: 2017 - RNA, 21 nt, Artificial Sequence
  Description of Artificial Sequence: Synthetic oligonucleotide
cagagaccugugccaauugca

SEQ ID NO: 2018 - RNA, 21 nt, Artificial Sequence
  Description of Artificial Sequence: Synthetic oligonucleotide
cugugccaauugcugguuuaa

SEQ ID NO: 2019 - RNA, 21 nt, Artificial Sequence
  Description of Artificial Sequence: Synthetic oligonucleotide
aauugcugguuuacaaaagua

SEQ ID NO: 2020 - RNA, 21 nt, Artificial Sequence
  Description of Artificial Sequence: Synthetic oligonucleotide
ggaugacaacagcuggacaca

SEQ ID NO: 2021 - RNA, 21 nt, Artificial Sequence
  Description of Artificial Sequence: Synthetic oligonucleotide
aacagcuggacacuaguggaa

SEQ ID NO: 2022 - RNA, 21 nt, Artificial Sequence
  Description of Artificial Sequence: Synthetic oligonucleotide
ggacacuaguggagcaccaca

SEQ ID NO: 2023 - RNA, 21 nt, Artificial Sequence
  Description of Artificial Sequence: Synthetic oligonucleotide
guggagcaccacccgcaccua

SEQ ID NO: 2024 - RNA, 21 nt, Artificial Sequence
  Description of Artificial Sequence: Synthetic oligonucleotide
accacccgcaccuaggauuaa

SEQ ID NO: 2025 - RNA, 21 nt, Artificial Sequence
  Description of Artificial Sequence: Synthetic oligonucleotide
aggugcuuggaagaccaugaa

SEQ ID NO: 2026 - RNA, 21 nt, Artificial Sequence
  Description of Artificial Sequence: Synthetic oligonucleotide
uggaagaccaugagcugguga

SEQ ID NO: 2027 - RNA, 21 nt, Artificial Sequence
  Description of Artificial Sequence: Synthetic oligonucleotide
ccaugagcuggugguccagga

SEQ ID NO: 2028 - RNA, 21 nt, Artificial Sequence
  Description of Artificial Sequence: Synthetic oligonucleotide
cuggugguccagguggagaga

SEQ ID NO: 2029 - RNA, 21 nt, Artificial Sequence
  Description of Artificial Sequence: Synthetic oligonucleotide
uccagguggagaguaccauga

SEQ ID NO: 2030 - RNA, 21 nt, Artificial Sequence
  Description of Artificial Sequence: Synthetic oligonucleotide
ggagaguaccauggccaguga

SEQ ID NO: 2031 - RNA, 21 nt, Artificial Sequence
  Description of Artificial Sequence: Synthetic oligonucleotide
accauggccagugagaguaaa

SEQ ID NO: 2032 - RNA, 21 nt, Artificial Sequence
  Description of Artificial Sequence: Synthetic oligonucleotide
ccagugagaguaaauuucuaa

SEQ ID NO: 2033 - RNA, 21 nt, Artificial Sequence
  Description of Artificial Sequence: Synthetic oligonucleotide
gaguaaauuucuauucaggaa

SEQ ID NO: 2034 - RNA, 21 nt, Artificial Sequence
  Description of Artificial Sequence: Synthetic oligonucleotide
uucuauucaggaagaauuaca

SEQ ID NO: 2035 - RNA, 21 nt, Artificial Sequence
  Description of Artificial Sequence: Synthetic oligonucleotide
caggaagaauuacgcaaaaua

SEQ ID NO: 2036 - RNA, 21 nt, Artificial Sequence
  Description of Artificial Sequence: Synthetic oligonucleotide
aauuacgcaaaauacgaguua

SEQ ID NO: 2037 - RNA, 21 nt, Artificial Sequence
  Description of Artificial Sequence: Synthetic oligonucleotide
caaaauacgaguucuuuaaaa

SEQ ID NO: 2038 - RNA, 21 nt, Artificial Sequence
  Description of Artificial Sequence: Synthetic oligonucleotide
uuucuucccagaacagaugga

SEQ ID NO: 2039 - RNA, 21 nt, Artificial Sequence
  Description of Artificial Sequence: Synthetic oligonucleotide
ccagaacagaugguuacuuga

SEQ ID NO: 2040 - RNA, 21 nt, Artificial Sequence
  Description of Artificial Sequence: Synthetic oligonucleotide
agaugguuacuuggugccaga

SEQ ID NO: 2041 - RNA, 21 nt, Artificial Sequence
  Description of Artificial Sequence: Synthetic oligonucleotide
uacuuggugccagcagucaaa

SEQ ID NO: 2042 - RNA, 21 nt, Artificial Sequence
  Description of Artificial Sequence: Synthetic oligonucleotide
ugccagcagucaaauggcaga

SEQ ID NO: 2043 - RNA, 21 nt, Artificial Sequence
  Description of Artificial Sequence: Synthetic oligonucleotide
agucaaauggcagucaaacca

SEQ ID NO: 2044 - RNA, 21 nt, Artificial Sequence
  Description of Artificial Sequence: Synthetic oligonucleotide
uggcagucaaacccagcuuua

SEQ ID NO: 2045 - RNA, 21 nt, Artificial Sequence
  Description of Artificial Sequence: Synthetic oligonucleotide
uuuucugaacuccaguaguua

SEQ ID NO: 2046 - RNA, 21 nt, Artificial Sequence
  Description of Artificial Sequence: Synthetic oligonucleotide
aacuccaguaguuguccugaa

SEQ ID NO: 2047 - RNA, 21 nt, Artificial Sequence
  Description of Artificial Sequence: Synthetic oligonucleotide
guaguuguccugaaauucaaa

SEQ ID NO: 2048 - RNA, 21 nt, Artificial Sequence
  Description of Artificial Sequence: Synthetic oligonucleotide
uugcaugugaaagagcuggga

SEQ ID NO: 2049 - RNA, 21 nt, Artificial Sequence
  Description of Artificial Sequence: Synthetic oligonucleotide
ugaaagagcugggaaagaaaa

SEQ ID NO: 2050 - RNA, 21 nt, Artificial Sequence
  Description of Artificial Sequence: Synthetic oligonucleotide
gcugggaaagaaaucauggaa

SEQ ID NO: 2051 - RNA, 21 nt, Artificial Sequence
  Description of Artificial Sequence: Synthetic oligonucleotide
aagcuguauguguguuugcga

SEQ ID NO: 2052 - RNA, 21 nt, Artificial Sequence
  Description of Artificial Sequence: Synthetic oligonucleotide
auguguguuugcggagaucua

SEQ ID NO: 2053 - RNA, 21 nt, Artificial Sequence
  Description of Artificial Sequence: Synthetic oligonucleotide
uuugcggagaucuggccuuua

SEQ ID NO: 2054 - RNA, 21 nt, Artificial Sequence
  Description of Artificial Sequence: Synthetic oligonucleotide
agaucuggccuuuauugcuca

SEQ ID NO: 2055 - RNA, 21 nt, Artificial Sequence
  Description of Artificial Sequence: Synthetic oligonucleotide
gccuuuauugcuccaccaaga

SEQ ID NO: 2056 - RNA, 21 nt, Artificial Sequence
  Description of Artificial Sequence: Synthetic oligonucleotide
uugcuccaccaagggaacuua

SEQ ID NO: 2057 - RNA, 21 nt, Artificial Sequence
  Description of Artificial Sequence: Synthetic oligonucleotide
gccgaccuggaggacagcaaa

SEQ ID NO: 2058 - RNA, 21 nt, Artificial Sequence
  Description of Artificial Sequence: Synthetic oligonucleotide
uggaggacagcaacaucuuca

SEQ ID NO: 2059 - RNA, 21 nt, Artificial Sequence
  Description of Artificial Sequence: Synthetic oligonucleotide
cagcaacaucuucucccugaa

SEQ ID NO: 2060 - RNA, 21 nt, Artificial Sequence
  Description of Artificial Sequence: Synthetic oligonucleotide
aucuucucccugaucgcugga

SEQ ID NO: 2061 - RNA, 21 nt, Artificial Sequence
  Description of Artificial Sequence: Synthetic oligonucleotide
cccugaucgcuggcaggaaga

SEQ ID NO: 2062 - RNA, 21 nt, Artificial Sequence
  Description of Artificial Sequence: Synthetic oligonucleotide
cgcuggcaggaagcaguacaa

SEQ ID NO: 2063 - RNA, 21 nt, Artificial Sequence
  Description of Artificial Sequence: Synthetic oligonucleotide
uacagaccacgggcucugcaa

SEQ ID NO: 2064 - RNA, 21 nt, Artificial Sequence
  Description of Artificial Sequence: Synthetic oligonucleotide
aaacaaagucaggaaugaaaa

SEQ ID NO: 2065 - RNA, 21 nt, Artificial Sequence
  Description of Artificial Sequence: Synthetic oligonucleotide
gucaggaaugaaacuaaagaa

SEQ ID NO: 2066 - RNA, 21 nt, Artificial Sequence
  Description of Artificial Sequence: Synthetic oligonucleotide
augaaacuaaagagcugagga

SEQ ID NO: 2067 - RNA, 21 nt, Artificial Sequence
  Description of Artificial Sequence: Synthetic oligonucleotide
uaaagagcugagguugcucua

SEQ ID NO: 2068 - RNA, 21 nt, Artificial Sequence
  Description of Artificial Sequence: Synthetic oligonucleotide
cugagguugcucugugcagaa

SEQ ID NO: 2069 - RNA, 21 nt, Artificial Sequence
  Description of Artificial Sequence: Synthetic oligonucleotide
ugcucugugcagaggacgaga

SEQ ID NO: 2070 - RNA, 21 nt, Artificial Sequence
  Description of Artificial Sequence: Synthetic oligonucleotide
ugcagaggacgagcaaaccaa

SEQ ID NO: 2071 - RNA, 21 nt, Artificial Sequence
  Description of Artificial Sequence: Synthetic oligonucleotide
gacgagcaaaccaggacguga

SEQ ID NO: 2072 - RNA, 21 nt, Artificial Sequence
  Description of Artificial Sequence: Synthetic oligonucleotide
aaaccaggacgugcuggauga

SEQ ID NO: 2073 - RNA, 21 nt, Artificial Sequence
  Description of Artificial Sequence: Synthetic oligonucleotide
gacgugcuggaugacagcgua

SEQ ID NO: 2074 - RNA, 21 nt, Artificial Sequence
  Description of Artificial Sequence: Synthetic oligonucleotide
uggaugacagcguucagacua

SEQ ID NO: 2075 - RNA, 21 nt, Artificial Sequence
  Description of Artificial Sequence: Synthetic oligonucleotide
uggaaugcuccuuuaccagaa

SEQ ID NO: 2076 - RNA, 21 nt, Artificial Sequence
  Description of Artificial Sequence: Synthetic oligonucleotide
cuccuuuaccagaauuaccga

SEQ ID NO: 2077 - RNA, 21 nt, Artificial Sequence
  Description of Artificial Sequence: Synthetic oligonucleotide
accagaauuaccgaaucccua

SEQ ID NO: 2078 - RNA, 21 nt, Artificial Sequence
  Description of Artificial Sequence: Synthetic oligonucleotide
uuaccgaaucccucagcagaa

SEQ ID NO: 2079 - RNA, 21 nt, Artificial Sequence
  Description of Artificial Sequence: Synthetic oligonucleotide
aucccucagcagaggaaggca

SEQ ID NO: 2080 - RNA, 21 nt, Artificial Sequence
  Description of Artificial Sequence: Synthetic oligonucleotide
agcagaggaaggccuugcuga

SEQ ID NO: 2081 - RNA, 21 nt, Artificial Sequence
  Description of Artificial Sequence: Synthetic oligonucleotide
cagugucuccgagaacuccca

SEQ ID NO: 2082 - RNA, 21 nt, Artificial Sequence
  Description of Artificial Sequence: Synthetic oligonucleotide
uccgagaacucccucguggca

SEQ ID NO: 2083 - RNA, 21 nt, Artificial Sequence
  Description of Artificial Sequence: Synthetic oligonucleotide
acucccucguggcaauggaua

SEQ ID NO: 2084 - RNA, 21 nt, Artificial Sequence
  Description of Artificial Sequence: Synthetic oligonucleotide
uucugggcaaacaggacgcga

SEQ ID NO: 2085 - RNA, 21 nt, Artificial Sequence
  Description of Artificial Sequence: Synthetic oligonucleotide
caaacaggacgcgugauagaa

SEQ ID NO: 2086 - RNA, 21 nt, Artificial Sequence
  Description of Artificial Sequence: Synthetic oligonucleotide
gacgcgugauagagaauccga

SEQ ID NO: 2087 - RNA, 21 nt, Artificial Sequence
  Description of Artificial Sequence: Synthetic oligonucleotide
gauagagaauccggcagagga

SEQ ID NO: 2088 - RNA, 21 nt, Artificial Sequence
  Description of Artificial Sequence: Synthetic oligonucleotide
aauccggcagaggcccagaga

SEQ ID NO: 2089 - RNA, 21 nt, Artificial Sequence
  Description of Artificial Sequence: Synthetic oligonucleotide
gcgaagcacacggaugaacaa

SEQ ID NO: 2090 - RNA, 21 nt, Artificial Sequence
  Description of Artificial Sequence: Synthetic oligonucleotide
acacggaugaacauccuagga

SEQ ID NO: 2091 - RNA, 21 nt, Artificial Sequence
  Description of Artificial Sequence: Synthetic oligonucleotide
ugaacauccuagguagccaaa

SEQ ID NO: 2092 - RNA, 21 nt, Artificial Sequence
  Description of Artificial Sequence: Synthetic oligonucleotide
cuccacccuucuacccuaaga

SEQ ID NO: 2093 - RNA, 21 nt, Artificial Sequence
  Description of Artificial Sequence: Synthetic oligonucleotide
auucacaggacacagcacuga

SEQ ID NO: 2094 - RNA, 21 nt, Artificial Sequence
  Description of Artificial Sequence: Synthetic oligonucleotide
ggacacagcacugguuucaca

SEQ ID NO: 2095 - RNA, 21 nt, Artificial Sequence
  Description of Artificial Sequence: Synthetic oligonucleotide
gcacugguuucacgggaggaa

SEQ ID NO: 2096 - RNA, 21 nt, Artificial Sequence
  Description of Artificial Sequence: Synthetic oligonucleotide
uuucacgggaggaucuccaga

SEQ ID NO: 2097 - RNA, 21 nt, Artificial Sequence
  Description of Artificial Sequence: Synthetic oligonucleotide
ggaggaucuccagggaggaaa

SEQ ID NO: 2098 - RNA, 21 nt, Artificial Sequence
  Description of Artificial Sequence: Synthetic oligonucleotide
cuccagggaggaaucccacaa

SEQ ID NO: 2099 - RNA, 21 nt, Artificial Sequence
  Description of Artificial Sequence: Synthetic oligonucleotide
gaggaaucccacaggaucaua

SEQ ID NO: 2100 - RNA, 21 nt, Artificial Sequence
  Description of Artificial Sequence: Synthetic oligonucleotide
cccacaggaucauuaaacaga

SEQ ID NO: 2101 - RNA, 21 nt, Artificial Sequence
  Description of Artificial Sequence: Synthetic oligonucleotide
gaucauuaaacagcaagggca

SEQ ID NO: 2102 - RNA, 21 nt, Artificial Sequence
  Description of Artificial Sequence: Synthetic oligonucleotide
aaacagcaagggcucguggaa

SEQ ID NO: 2103 - RNA, 23 nt, Artificial Sequence
  Description of Artificial Sequence: Synthetic oligonucleotide
ucuggucuuccuccugaaggcgc

SEQ ID NO: 2104 - RNA, 23 nt, Artificial Sequence
  Description of Artificial Sequence: Synthetic oligonucleotide
ugucccaucuucacuaaagacuu

SEQ ID NO: 2105 - RNA, 23 nt, Artificial Sequence
  Description of Artificial Sequence: Synthetic oligonucleotide
ucacagugacuuuuguaaaccag

SEQ ID NO: 2106 - RNA, 23 nt, Artificial Sequence
  Description of Artificial Sequence: Synthetic oligonucleotide
uucauccacacagugacuuuugu

SEQ ID NO: 2107 - RNA, 23 nt, Artificial Sequence
  Description of Artificial Sequence: Synthetic oligonucleotide
ugcuguugucauccacacaguga

SEQ ID NO: 2108 - RNA, 23 nt, Artificial Sequence
  Description of Artificial Sequence: Synthetic oligonucleotide
ugcagcugcaggugucuggguuc

SEQ ID NO: 2109 - RNA, 23 nt, Artificial Sequence
  Description of Artificial Sequence: Synthetic oligonucleotide
ugaggugucugcuccaccuuguc

SEQ ID NO: 2110 - RNA, 23 nt, Artificial Sequence
  Description of Artificial Sequence: Synthetic oligonucleotide
uugacugcgaggugucugcucca

SEQ ID NO: 2111 - RNA, 23 nt, Artificial Sequence
  Description of Artificial Sequence: Synthetic oligonucleotide
ugucuuguugacugcgagguguc

SEQ ID NO: 2112 - RNA, 23 nt, Artificial Sequence
  Description of Artificial Sequence: Synthetic oligonucleotide
ucugccgggucuuguugacugcg

SEQ ID NO: 2113 - RNA, 23 nt, Artificial Sequence
  Description of Artificial Sequence: Synthetic oligonucleotide
uccugguccugccgggucuuguu

SEQ ID NO: 2114 - RNA, 23 nt, Artificial Sequence
  Description of Artificial Sequence: Synthetic oligonucleotide
ucaagucggucagacugugcggg

SEQ ID NO: 2115 - RNA, 23 nt, Artificial Sequence
  Description of Artificial Sequence: Synthetic oligonucleotide
uugauucgcaagucggucagacu

SEQ ID NO: 2116 - RNA, 23 nt, Artificial Sequence
  Description of Artificial Sequence: Synthetic oligonucleotide
ugcuuccagguccacaucauccu

SEQ ID NO: 2117 - RNA, 23 nt, Artificial Sequence
  Description of Artificial Sequence: Synthetic oligonucleotide
ucaccagggcuuccagguccaca

SEQ ID NO: 2118 - RNA, 23 nt, Artificial Sequence
  Description of Artificial Sequence: Synthetic oligonucleotide
uuaucguucaccagggcuuccag

SEQ ID NO: 2119 - RNA, 23 nt, Artificial Sequence
  Description of Artificial Sequence: Synthetic oligonucleotide
ugcauucauaucguucaccaggg

SEQ ID NO: 2120 - RNA, 23 nt, Artificial Sequence
  Description of Artificial Sequence: Synthetic oligonucleotide
ucagggaugcauucauaucguuc

SEQ ID NO: 2121 - RNA, 23 nt, Artificial Sequence
  Description of Artificial Sequence: Synthetic oligonucleotide
uggcucuccagggaugcauucau

SEQ ID NO: 2122 - RNA, 23 nt, Artificial Sequence
  Description of Artificial Sequence: Synthetic oligonucleotide
ugaguacaggcucuccagggaug

SEQ ID NO: 2123 - RNA, 23 nt, Artificial Sequence
  Description of Artificial Sequence: Synthetic oligonucleotide
uugcaggccgaguacaggcucuc

SEQ ID NO: 2124 - RNA, 23 nt, Artificial Sequence
  Description of Artificial Sequence: Synthetic oligonucleotide
uugcaugcugcaggccgaguaca

SEQ ID NO: 2125 - RNA, 23 nt, Artificial Sequence
  Description of Artificial Sequence: Synthetic oligonucleotide
ugucugacugcaugcugcaggcc

SEQ ID NO: 2126 - RNA, 23 nt, Artificial Sequence
  Description of Artificial Sequence: Synthetic oligonucleotide
ugcaccgugucugacugcaugcu

SEQ ID NO: 2127 - RNA, 23 nt, Artificial Sequence
  Description of Artificial Sequence: Synthetic oligonucleotide
uugcuggccauucugcaggaggg

SEQ ID NO: 2128 - RNA, 23 nt, Artificial Sequence
  Description of Artificial Sequence: Synthetic oligonucleotide
uugcgggcaugcuggccauucug

SEQ ID NO: 2129 - RNA, 23 nt, Artificial Sequence
  Description of Artificial Sequence: Synthetic oligonucleotide
uauggaccgaggagggccugaag

SEQ ID NO: 2130 - RNA, 23 nt, Artificial Sequence
  Description of Artificial Sequence: Synthetic oligonucleotide
uuguggcuggauggaccgaggag

SEQ ID NO: 2131 - RNA, 23 nt, Artificial Sequence
  Description of Artificial Sequence: Synthetic oligonucleotide
uggacaccuguggcuggauggac

SEQ ID NO: 2132 - RNA, 23 nt, Artificial Sequence
  Description of Artificial Sequence: Synthetic oligonucleotide
uaugugcacaggcugggagcgcu

SEQ ID NO: 2133 - RNA, 23 nt, Artificial Sequence
  Description of Artificial Sequence: Synthetic oligonucleotide
uagcgaggaugugcacaggcugg

SEQ ID NO: 2134 - RNA, 23 nt, Artificial Sequence
  Description of Artificial Sequence: Synthetic oligonucleotide
uuaaacugcuggucuuccuccug

SEQ ID NO: 2135 - RNA, 23 nt, Artificial Sequence
  Description of Artificial Sequence: Synthetic oligonucleotide
ugagguucuaaacugcuggucuu

SEQ ID NO: 2136 - RNA, 23 nt, Artificial Sequence
  Description of Artificial Sequence: Synthetic oligonucleotide
ucagagaugagguucuaaacugc

SEQ ID NO: 2137 - RNA, 23 nt, Artificial Sequence
  Description of Artificial Sequence: Synthetic oligonucleotide
uuggccggcagagaugagguucu

SEQ ID NO: 2138 - RNA, 23 nt, Artificial Sequence
  Description of Artificial Sequence: Synthetic oligonucleotide
uagaguucaggaaaaggauuggg

SEQ ID NO: 2139 - RNA, 23 nt, Artificial Sequence
  Description of Artificial Sequence: Synthetic oligonucleotide
ugggccacagaguucaggaaaag

SEQ ID NO: 2140 - RNA, 23 nt, Artificial Sequence
  Description of Artificial Sequence: Synthetic oligonucleotide
ugcucccagggccacagaguuca

SEQ ID NO: 2141 - RNA, 23 nt, Artificial Sequence
  Description of Artificial Sequence: Synthetic oligonucleotide
uaagaacccggcgugagcacagg

SEQ ID NO: 2142 - RNA, 23 nt, Artificial Sequence
  Description of Artificial Sequence: Synthetic oligonucleotide
uggagguaaagaacccggcguga

SEQ ID NO: 2143 - RNA, 23 nt, Artificial Sequence
  Description of Artificial Sequence: Synthetic oligonucleotide
ucuggcucggagguaaagaaccc

SEQ ID NO: 2144 - RNA, 23 nt, Artificial Sequence
  Description of Artificial Sequence: Synthetic oligonucleotide
uagaaucuccaccacuuugcuug

SEQ ID NO: 2145 - RNA, 23 nt, Artificial Sequence
  Description of Artificial Sequence: Synthetic oligonucleotide
ucuucacuaaagacuuuaacauc

SEQ ID NO: 2146 - RNA, 23 nt, Artificial Sequence
  Description of Artificial Sequence: Synthetic oligonucleotide
uuuugcuugucccaucuucacua

SEQ ID NO: 2147 - RNA, 23 nt, Artificial Sequence
  Description of Artificial Sequence: Synthetic oligonucleotide
uccaccacuuugcuugucccauc

SEQ ID NO: 2148 - RNA, 23 nt, Artificial Sequence
  Description of Artificial Sequence: Synthetic oligonucleotide
ugucugcuagaaucuccaccacu

SEQ ID NO: 2149 - RNA, 23 nt, Artificial Sequence
  Description of Artificial Sequence: Synthetic oligonucleotide
ucugucaugucugcuagaaucuc

SEQ ID NO: 2150 - RNA, 23 nt, Artificial Sequence
  Description of Artificial Sequence: Synthetic oligonucleotide
uucucuggcugucaugucugcua

SEQ ID NO: 2151 - RNA, 23 nt, Artificial Sequence
  Description of Artificial Sequence: Synthetic oligonucleotide
ugcacaggucucuggcugucaug

SEQ ID NO: 2152 - RNA, 23 nt, Artificial Sequence
  Description of Artificial Sequence: Synthetic oligonucleotide
ugcaauuggcacaggucucuggc

SEQ ID NO: 2153 - RNA, 23 nt, Artificial Sequence
  Description of Artificial Sequence: Synthetic oligonucleotide
uuaaaccagcaauuggcacaggu

SEQ ID NO: 2154 - RNA, 23 nt, Artificial Sequence
  Description of Artificial Sequence: Synthetic oligonucleotide
uacuuuuguaaaccagcaauugg

SEQ ID NO: 2155 - RNA, 23 nt, Artificial Sequence
  Description of Artificial Sequence: Synthetic oligonucleotide
uguguccagcuguugucauccac

SEQ ID NO: 2156 - RNA, 23 nt, Artificial Sequence
  Description of Artificial Sequence: Synthetic oligonucleotide
uuccacuaguguccagcuguugu

SEQ ID NO: 2157 - RNA, 23 nt, Artificial Sequence
  Description of Artificial Sequence: Synthetic oligonucleotide
uguggugcuccacuaguguccag

SEQ ID NO: 2158 - RNA, 23 nt, Artificial Sequence
  Description of Artificial Sequence: Synthetic oligonucleotide
uaggugcggguggugcuccacua

SEQ ID NO: 2159 - RNA, 23 nt, Artificial Sequence
  Description of Artificial Sequence: Synthetic oligonucleotide
uuaauccuaggugcggguggugc

SEQ ID NO: 2160 - RNA, 23 nt, Artificial Sequence
  Description of Artificial Sequence: Synthetic oligonucleotide
uucauggucuuccaagcaccucu

SEQ ID NO: 2161 - RNA, 23 nt, Artificial Sequence
  Description of Artificial Sequence: Synthetic oligonucleotide
ucaccagcucauggucuuccaag

SEQ ID NO: 2162 - RNA, 23 nt, Artificial Sequence
  Description of Artificial Sequence: Synthetic oligonucleotide
uccuggaccaccagcucaugguc

SEQ ID NO: 2163 - RNA, 23 nt, Artificial Sequence
  Description of Artificial Sequence: Synthetic oligonucleotide
ucucuccaccuggaccaccagcu

SEQ ID NO: 2164 - RNA, 23 nt, Artificial Sequence
  Description of Artificial Sequence: Synthetic oligonucleotide
ucaugguacucuccaccuggacc

SEQ ID NO: 2165 - RNA, 23 nt, Artificial Sequence
  Description of Artificial Sequence: Synthetic oligonucleotide
ucacuggccaugguacucuccac

SEQ ID NO: 2166 - RNA, 23 nt, Artificial Sequence
  Description of Artificial Sequence: Synthetic oligonucleotide
uuuacucucacuggccaugguac

SEQ ID NO: 2167 - RNA, 23 nt, Artificial Sequence
  Description of Artificial Sequence: Synthetic oligonucleotide
uuagaaauuuacucucacuggcc

SEQ ID NO: 2168 - RNA, 23 nt, Artificial Sequence
  Description of Artificial Sequence: Synthetic oligonucleotide
uuccugaauagaaauuuacucuc

SEQ ID NO: 2169 - RNA, 23 nt, Artificial Sequence
  Description of Artificial Sequence: Synthetic oligonucleotide
uguaauucuuccugaauagaaau

SEQ ID NO: 2170 - RNA, 23 nt, Artificial Sequence
  Description of Artificial Sequence: Synthetic oligonucleotide
uauuuugcguaauucuuccugaa

SEQ ID NO: 2171 - RNA, 23 nt, Artificial Sequence
  Description of Artificial Sequence: Synthetic oligonucleotide
uaacucguauuuugcguaauucu

SEQ ID NO: 2172 - RNA, 23 nt, Artificial Sequence
  Description of Artificial Sequence: Synthetic oligonucleotide
uuuuaaagaacucguauuuugcg

SEQ ID NO: 2173 - RNA, 23 nt, Artificial Sequence
  Description of Artificial Sequence: Synthetic oligonucleotide
uccaucuguucugggaagaaauu

SEQ ID NO: 2174 - RNA, 23 nt, Artificial Sequence
  Description of Artificial Sequence: Synthetic oligonucleotide
ucaaguaaccaucuguucuggga

SEQ ID NO: 2175 - RNA, 23 nt, Artificial Sequence
  Description of Artificial Sequence: Synthetic oligonucleotide
ucuggcaccaaguaaccaucugu

SEQ ID NO: 2176 - RNA, 23 nt, Artificial Sequence
  Description of Artificial Sequence: Synthetic oligonucleotide
uuugacugcuggcaccaaguaac

SEQ ID NO: 2177 - RNA, 23 nt, Artificial Sequence
  Description of Artificial Sequence: Synthetic oligonucleotide
ucugccauuugacugcuggcacc

SEQ ID NO: 2178 - RNA, 23 nt, Artificial Sequence
  Description of Artificial Sequence: Synthetic oligonucleotide
ugguuugacugccauuugacugc

SEQ ID NO: 2179 - RNA, 23 nt, Artificial Sequence
  Description of Artificial Sequence: Synthetic oligonucleotide
uaaagcuggguuugacugccauu

SEQ ID NO: 2180 - RNA, 23 nt, Artificial Sequence
  Description of Artificial Sequence: Synthetic oligonucleotide
uaacuacuggaguucagaaaauu

SEQ ID NO: 2181 - RNA, 23 nt, Artificial Sequence
  Description of Artificial Sequence: Synthetic oligonucleotide
uucaggacaacuacuggaguuca

SEQ ID NO: 2182 - RNA, 23 nt, Artificial Sequence
  Description of Artificial Sequence: Synthetic oligonucleotide
uuugaauuucaggacaacuacug

SEQ ID NO: 2183 - RNA, 23 nt, Artificial Sequence
  Description of Artificial Sequence: Synthetic oligonucleotide
ucccagcucuuucacaugcaaaa

SEQ ID NO: 2184 - RNA, 23 nt, Artificial Sequence
  Description of Artificial Sequence: Synthetic oligonucleotide
uuuucuuucccagcucuuucaca

SEQ ID NO: 2185 - RNA, 23 nt, Artificial Sequence
  Description of Artificial Sequence: Synthetic oligonucleotide
uuccaugauuucuuucccagcuc

SEQ ID NO: 2186 - RNA, 23 nt, Artificial Sequence
  Description of Artificial Sequence: Synthetic oligonucleotide
ucgcaaacacacauacagcuuuu

SEQ ID NO: 2187 - RNA, 23 nt, Artificial Sequence
  Description of Artificial Sequence: Synthetic oligonucleotide
uagaucuccgcaaacacacauac

SEQ ID NO: 2188 - RNA, 23 nt, Artificial Sequence
  Description of Artificial Sequence: Synthetic oligonucleotide
uaaaggccagaucuccgcaaaca

SEQ ID NO: 2189 - RNA, 23 nt, Artificial Sequence
  Description of Artificial Sequence: Synthetic oligonucleotide
ugagcaauaaaggccagaucucc

SEQ ID NO: 2190 - RNA, 23 nt, Artificial Sequence
  Description of Artificial Sequence: Synthetic oligonucleotide
ucuugguggagcaauaaaggcca

SEQ ID NO: 2191 - RNA, 23 nt, Artificial Sequence
  Description of Artificial Sequence: Synthetic oligonucleotide
uaaguucccuugguggagcaaua

SEQ ID NO: 2192 - RNA, 23 nt, Artificial Sequence
  Description of Artificial Sequence: Synthetic oligonucleotide
uuugcuguccuccaggucggcca

SEQ ID NO: 2193 - RNA, 23 nt, Artificial Sequence
  Description of Artificial Sequence: Synthetic oligonucleotide
ugaagauguugcuguccuccagg

SEQ ID NO: 2194 - RNA, 23 nt, Artificial Sequence
  Description of Artificial Sequence: Synthetic oligonucleotide
uucagggagaagauguugcuguc

SEQ ID NO: 2195 - RNA, 23 nt, Artificial Sequence
  Description of Artificial Sequence: Synthetic oligonucleotide
uccagcgaucagggagaagaugu

SEQ ID NO: 2196 - RNA, 23 nt, Artificial Sequence
  Description of Artificial Sequence: Synthetic oligonucleotide
ucuuccugccagcgaucagggag

SEQ ID NO: 2197 - RNA, 23 nt, Artificial Sequence
  Description of Artificial Sequence: Synthetic oligonucleotide
uuguacugcuuccugccagcgau

SEQ ID NO: 2198 - RNA, 23 nt, Artificial Sequence
  Description of Artificial Sequence: Synthetic oligonucleotide
uugcagagcccguggucuguagg

SEQ ID NO: 2199 - RNA, 23 nt, Artificial Sequence
  Description of Artificial Sequence: Synthetic oligonucleotide
uuuucauuccugacuuuguuugg

SEQ ID NO: 2200 - RNA, 23 nt, Artificial Sequence
  Description of Artificial Sequence: Synthetic oligonucleotide
uucuuuaguuucauuccugacuu

SEQ ID NO: 2201 - RNA, 23 nt, Artificial Sequence
  Description of Artificial Sequence: Synthetic oligonucleotide
uccucagcucuuuaguuucauuc

SEQ ID NO: 2202 - RNA, 23 nt, Artificial Sequence
  Description of Artificial Sequence: Synthetic oligonucleotide
uagagcaaccucagcucuuuagu

SEQ ID NO: 2203 - RNA, 23 nt, Artificial Sequence
  Description of Artificial Sequence: Synthetic oligonucleotide
uucugcacagagcaaccucagcu

SEQ ID NO: 2204 - RNA, 23 nt, Artificial Sequence
  Description of Artificial Sequence: Synthetic oligonucleotide
ucucguccucugcacagagcaac

SEQ ID NO: 2205 - RNA, 23 nt, Artificial Sequence
  Description of Artificial Sequence: Synthetic oligonucleotide
uugguuugcucguccucugcaca

SEQ ID NO: 2206 - RNA, 23 nt, Artificial Sequence
  Description of Artificial Sequence: Synthetic oligonucleotide
ucacguccugguuugcucguccu

SEQ ID NO: 2207 - RNA, 23 nt, Artificial Sequence
  Description of Artificial Sequence: Synthetic oligonucleotide
ucauccagcacguccugguuugc

SEQ ID NO: 2208 - RNA, 23 nt, Artificial Sequence
  Description of Artificial Sequence: Synthetic oligonucleotide
uacgcugucauccagcacguccu

SEQ ID NO: 2209 - RNA, 23 nt, Artificial Sequence
  Description of Artificial Sequence: Synthetic oligonucleotide
uagucugaacgcugucauccagc

SEQ ID NO: 2210 - RNA, 23 nt, Artificial Sequence
  Description of Artificial Sequence: Synthetic oligonucleotide
uucugguaaaggagcauuccaua

SEQ ID NO: 2211 - RNA, 23 nt, Artificial Sequence
  Description of Artificial Sequence: Synthetic oligonucleotide
ucgguaauucugguaaaggagca

SEQ ID NO: 2212 - RNA, 23 nt, Artificial Sequence
  Description of Artificial Sequence: Synthetic oligonucleotide
uagggauucgguaauucugguaa

SEQ ID NO: 2213 - RNA, 23 nt, Artificial Sequence
  Description of Artificial Sequence: Synthetic oligonucleotide
uucugcugagggauucgguaauu

SEQ ID NO: 2214 - RNA, 23 nt, Artificial Sequence
  Description of Artificial Sequence: Synthetic oligonucleotide
ugccuuccucugcugagggauuc

SEQ ID NO: 2215 - RNA, 23 nt, Artificial Sequence
  Description of Artificial Sequence: Synthetic oligonucleotide
ucagcaaggccuuccucugcuga

SEQ ID NO: 2216 - RNA, 23 nt, Artificial Sequence
  Description of Artificial Sequence: Synthetic oligonucleotide
ugggaguucucggagacacugcg

SEQ ID NO: 2217 - RNA, 23 nt, Artificial Sequence
  Description of Artificial Sequence: Synthetic oligonucleotide
ugccacgagggaguucucggaga

SEQ ID NO: 2218 - RNA, 23 nt, Artificial Sequence
  Description of Artificial Sequence: Synthetic oligonucleotide
uauccauugccacgagggaguuc

SEQ ID NO: 2219 - RNA, 23 nt, Artificial Sequence
  Description of Artificial Sequence: Synthetic oligonucleotide
ucgcguccuguuugcccagaaaa

SEQ ID NO: 2220 - RNA, 23 nt, Artificial Sequence
  Description of Artificial Sequence: Synthetic oligonucleotide
uucuaucacgcguccuguuugcc

SEQ ID NO: 2221 - RNA, 23 nt, Artificial Sequence
  Description of Artificial Sequence: Synthetic oligonucleotide
ucggauucucuaucacgcguccu

SEQ ID NO: 2222 - RNA, 23 nt, Artificial Sequence
  Description of Artificial Sequence: Synthetic oligonucleotide
uccucugccggauucucuaucac

SEQ ID NO: 2223 - RNA, 23 nt, Artificial Sequence
  Description of Artificial Sequence: Synthetic oligonucleotide
ucucugggccucugccggauucu

SEQ ID NO: 2224 - RNA, 23 nt, Artificial Sequence
  Description of Artificial Sequence: Synthetic oligonucleotide
uuguucauccgugugcuucgcuu

SEQ ID NO: 2225 - RNA, 23 nt, Artificial Sequence
  Description of Artificial Sequence: Synthetic oligonucleotide
uccuaggauguucauccgugugc

SEQ ID NO: 2226 - RNA, 23 nt, Artificial Sequence
  Description of Artificial Sequence: Synthetic oligonucleotide
uuuggcuaccuaggauguucauc

SEQ ID NO: 2227 - RNA, 23 nt, Artificial Sequence
  Description of Artificial Sequence: Synthetic oligonucleotide
ucuuaggguagaaggguggaggg

SEQ ID NO: 2228 - RNA, 23 nt, Artificial Sequence
  Description of Artificial Sequence: Synthetic oligonucleotide
ucagugcuguguccugugaauca

SEQ ID NO: 2229 - RNA, 23 nt, Artificial Sequence
  Description of Artificial Sequence: Synthetic oligonucleotide
ugugaaaccagugcuguguccug

SEQ ID NO: 2230 - RNA, 23 nt, Artificial Sequence
  Description of Artificial Sequence: Synthetic oligonucleotide
uuccucccgugaaaccagugcug

SEQ ID NO: 2231 - RNA, 23 nt, Artificial Sequence
  Description of Artificial Sequence: Synthetic oligonucleotide
ucuggagauccucccgugaaacc

SEQ ID NO: 2232 - RNA, 23 nt, Artificial Sequence
  Description of Artificial Sequence: Synthetic oligonucleotide
uuuccucccuggagauccucccg

SEQ ID NO: 2233 - RNA, 23 nt, Artificial Sequence
  Description of Artificial Sequence: Synthetic oligonucleotide
uugugggauuccucccuggagau

SEQ ID NO: 2234 - RNA, 23 nt, Artificial Sequence
  Description of Artificial Sequence: Synthetic oligonucleotide
uaugauccugugggauuccuccc

SEQ ID NO: 2235 - RNA, 23 nt, Artificial Sequence
  Description of Artificial Sequence: Synthetic oligonucleotide
ucuguuuaaugauccugugggau

SEQ ID NO: 2236 - RNA, 23 nt, Artificial Sequence
  Description of Artificial Sequence: Synthetic oligonucleotide
ugcccuugcuguuuaaugauccu

SEQ ID NO: 2237 - RNA, 23 nt, Artificial Sequence
  Description of Artificial Sequence: Synthetic oligonucleotide
uuccacgagcccuugcuguuuaa

SEQ ID NO: 2238 - RNA, 21 nt, Artificial Sequence
  Description of Artificial Sequence: Synthetic oligonucleotide
gccuucaggaggaagaccaga

SEQ ID NO: 2239 - RNA, 21 nt, Artificial Sequence
  Description of Artificial Sequence: Synthetic oligonucleotide
gucuuuagugaagaugggaca

SEQ ID NO: 2240 - RNA, 21 nt, Artificial Sequence
  Description of Artificial Sequence: Synthetic oligonucleotide
gguuuacaaaagucacuguga

SEQ ID NO: 2241 - RNA, 21 nt, Artificial Sequence
  Description of Artificial Sequence: Synthetic oligonucleotide
aaaagucacuguguggaugaa

SEQ ID NO: 2242 - RNA, 21 nt, Artificial Sequence
  Description of Artificial Sequence: Synthetic oligonucleotide
acuguguggaugacaacagca

SEQ ID NO: 2243 - RNA, 21 nt, Artificial Sequence
  Description of Artificial Sequence: Synthetic oligonucleotide
acccagacaccugcagcugca

SEQ ID NO: 2244 - RNA, 21 nt, Artificial Sequence
  Description of Artificial Sequence: Synthetic oligonucleotide
caagguggagcagacaccuca

SEQ ID NO: 2245 - RNA, 21 nt, Artificial Sequence
  Description of Artificial Sequence: Synthetic oligonucleotide
gagcagacaccucgcagucaa

SEQ ID NO: 2246 - RNA, 21 nt, Artificial Sequence
  Description of Artificial Sequence: Synthetic oligonucleotide
caccucgcagucaacaagaca

SEQ ID NO: 2247 - RNA, 21 nt, Artificial Sequence
  Description of Artificial Sequence: Synthetic oligonucleotide
cagucaacaagacccggcaga

SEQ ID NO: 2248 - RNA, 21 nt, Artificial Sequence
  Description of Artificial Sequence: Synthetic oligonucleotide
caagacccggcaggaccagga

SEQ ID NO: 2249 - RNA, 21 nt, Artificial Sequence
  Description of Artificial Sequence: Synthetic oligonucleotide
cgcacagucugaccgacuuga

SEQ ID NO: 2250 - RNA, 21 nt, Artificial Sequence
  Description of Artificial Sequence: Synthetic oligonucleotide
ucugaccgacuugcgaaucaa

SEQ ID NO: 2251 - RNA, 21 nt, Artificial Sequence
  Description of Artificial Sequence: Synthetic oligonucleotide
gaugauguggaccuggaagca

SEQ ID NO: 2252 - RNA, 21 nt, Artificial Sequence
  Description of Artificial Sequence: Synthetic oligonucleotide
uggaccuggaagcccugguga

SEQ ID NO: 2253 - RNA, 21 nt, Artificial Sequence
  Description of Artificial Sequence: Synthetic oligonucleotide
ggaagcccuggugaacgauaa

SEQ ID NO: 2254 - RNA, 21 nt, Artificial Sequence
  Description of Artificial Sequence: Synthetic oligonucleotide
cuggugaacgauaugaaugca

SEQ ID NO: 2255 - RNA, 21 nt, Artificial Sequence
  Description of Artificial Sequence: Synthetic oligonucleotide
acgauaugaaugcaucccuga

SEQ ID NO: 2256 - RNA, 21 nt, Artificial Sequence
  Description of Artificial Sequence: Synthetic oligonucleotide
gaaugcaucccuggagagcca

SEQ ID NO: 2257 - RNA, 21 nt, Artificial Sequence
  Description of Artificial Sequence: Synthetic oligonucleotide
ucccuggagagccuguacuca

SEQ ID NO: 2258 - RNA, 21 nt, Artificial Sequence
  Description of Artificial Sequence: Synthetic oligonucleotide
gagccuguacucggccugcaa

SEQ ID NO: 2259 - RNA, 21 nt, Artificial Sequence
  Description of Artificial Sequence: Synthetic oligonucleotide
uacucggccugcagcaugcaa

SEQ ID NO: 2260 - RNA, 21 nt, Artificial Sequence
  Description of Artificial Sequence: Synthetic oligonucleotide
ccugcagcaugcagucagaca

SEQ ID NO: 2261 - RNA, 21 nt, Artificial Sequence
  Description of Artificial Sequence: Synthetic oligonucleotide
caugcagucagacacggugca

SEQ ID NO: 2262 - RNA, 21 nt, Artificial Sequence
  Description of Artificial Sequence: Synthetic oligonucleotide
cuccugcagaauggccagcaa

SEQ ID NO: 2263 - RNA, 21 nt, Artificial Sequence
  Description of Artificial Sequence: Synthetic oligonucleotide
gaauggccagcaugcccgcaa

SEQ ID NO: 2264 - RNA, 21 nt, Artificial Sequence
  Description of Artificial Sequence: Synthetic oligonucleotide
ucaggcccuccucgguccaua

SEQ ID NO: 2265 - RNA, 21 nt, Artificial Sequence
  Description of Artificial Sequence: Synthetic oligonucleotide
ccucgguccauccagccacaa

SEQ ID NO: 2266 - RNA, 21 nt, Artificial Sequence
  Description of Artificial Sequence: Synthetic oligonucleotide
ccauccagccacaggugucca

SEQ ID NO: 2267 - RNA, 21 nt, Artificial Sequence
  Description of Artificial Sequence: Synthetic oligonucleotide
cgcucccagccugugcacaua

SEQ ID NO: 2268 - RNA, 21 nt, Artificial Sequence
  Description of Artificial Sequence: Synthetic oligonucleotide
agccugugcacauccucgcua

SEQ ID NO: 2269 - RNA, 21 nt, Artificial Sequence
  Description of Artificial Sequence: Synthetic oligonucleotide
ggaggaagaccagcaguuuaa

SEQ ID NO: 2270 - RNA, 21 nt, Artificial Sequence
  Description of Artificial Sequence: Synthetic oligonucleotide
gaccagcaguuuagaaccuca

SEQ ID NO: 2271 - RNA, 21 nt, Artificial Sequence
  Description of Artificial Sequence: Synthetic oligonucleotide
aguuuagaaccucaucucuga

SEQ ID NO: 2272 - RNA, 21 nt, Artificial Sequence
  Description of Artificial Sequence: Synthetic oligonucleotide
aaccucaucucugccggccaa

SEQ ID NO: 2273 - RNA, 21 nt, Artificial Sequence
  Description of Artificial Sequence: Synthetic oligonucleotide
caauccuuuuccugaacucua

SEQ ID NO: 2274 - RNA, 21 nt, Artificial Sequence
  Description of Artificial Sequence: Synthetic oligonucleotide
uuuccugaacucuguggccca

SEQ ID NO: 2275 - RNA, 21 nt, Artificial Sequence
  Description of Artificial Sequence: Synthetic oligonucleotide
aacucuguggcccugggagca

SEQ ID NO: 2276 - RNA, 21 nt, Artificial Sequence
  Description of Artificial Sequence: Synthetic oligonucleotide
ugugcucacgccggguucuua

SEQ ID NO: 2277 - RNA, 21 nt, Artificial Sequence
  Description of Artificial Sequence: Synthetic oligonucleotide
acgccggguucuuuaccucca

SEQ ID NO: 2278 - RNA, 21 nt, Artificial Sequence
  Description of Artificial Sequence: Synthetic oligonucleotide
guucuuuaccuccgagccaga

SEQ ID NO: 2279 - RNA, 21 nt, Artificial Sequence
  Description of Artificial Sequence: Synthetic oligonucleotide
agcaaagugguggagauucua

SEQ ID NO: 2280 - RNA, 21 nt, Artificial Sequence
  Description of Artificial Sequence: Synthetic oligonucleotide
uguuaaagucuuuagugaaga

SEQ ID NO: 2281 - RNA, 21 nt, Artificial Sequence
  Description of Artificial Sequence: Synthetic oligonucleotide
gugaagaugggacaagcaaaa

SEQ ID NO: 2282 - RNA, 21 nt, Artificial Sequence
  Description of Artificial Sequence: Synthetic oligonucleotide
ugggacaagcaaaguggugga

SEQ ID NO: 2283 - RNA, 21 nt, Artificial Sequence
  Description of Artificial Sequence: Synthetic oligonucleotide
ugguggagauucuagcagaca

SEQ ID NO: 2284 - RNA, 21 nt, Artificial Sequence
  Description of Artificial Sequence: Synthetic oligonucleotide
gauucuagcagacaugacaga

SEQ ID NO: 2285 - RNA, 21 nt, Artificial Sequence
  Description of Artificial Sequence: Synthetic oligonucleotide
gcagacaugacagccagagaa

SEQ ID NO: 2286 - RNA, 21 nt, Artificial Sequence
  Description of Artificial Sequence: Synthetic oligonucleotide
ugacagccagagaccugugca

SEQ ID NO: 2287 - RNA, 21 nt, Artificial Sequence
  Description of Artificial Sequence: Synthetic oligonucleotide
cagagaccugugccaauugca

SEQ ID NO: 2288 - RNA, 21 nt, Artificial Sequence
  Description of Artificial Sequence: Synthetic oligonucleotide
cugugccaauugcugguuuaa

SEQ ID NO: 2289 - RNA, 21 nt, Artificial Sequence
  Description of Artificial Sequence: Synthetic oligonucleotide
aauugcugguuuacaaaagua

SEQ ID NO: 2290 - RNA, 21 nt, Artificial Sequence
  Description of Artificial Sequence: Synthetic oligonucleotide
ggaugacaacagcuggacaca

SEQ ID NO: 2291 - RNA, 21 nt, Artificial Sequence
  Description of Artificial Sequence: Synthetic oligonucleotide
aacagcuggacacuaguggaa

SEQ ID NO: 2292 - RNA, 21 nt, Artificial Sequence
  Description of Artificial Sequence: Synthetic oligonucleotide
ggacacuaguggagcaccaca

SEQ ID NO: 2293 - RNA, 21 nt, Artificial Sequence
  Description of Artificial Sequence: Synthetic oligonucleotide
guggagcaccacccgcaccua

SEQ ID NO: 2294 - RNA, 21 nt, Artificial Sequence
  Description of Artificial Sequence: Synthetic oligonucleotide
accacccgcaccuaggauuaa

SEQ ID NO: 2295 - RNA, 21 nt, Artificial Sequence
  Description of Artificial Sequence: Synthetic oligonucleotide
aggugcuuggaagaccaugaa

SEQ ID NO: 2296 - RNA, 21 nt, Artificial Sequence
  Description of Artificial Sequence: Synthetic oligonucleotide
uggaagaccaugagcugguga

SEQ ID NO: 2297 - RNA, 21 nt, Artificial Sequence
  Description of Artificial Sequence: Synthetic oligonucleotide
ccaugagcuggugguccagga

SEQ ID NO: 2298 - RNA, 21 nt, Artificial Sequence
  Description of Artificial Sequence: Synthetic oligonucleotide
cuggugguccagguggagaga

SEQ ID NO: 2299 - RNA, 21 nt, Artificial Sequence
  Description of Artificial Sequence: Synthetic oligonucleotide
uccagguggagaguaccauga

SEQ ID NO: 2300 - RNA, 21 nt, Artificial Sequence
  Description of Artificial Sequence: Synthetic oligonucleotide
ggagaguaccauggccaguga

SEQ ID NO: 2301 - RNA, 21 nt, Artificial Sequence
  Description of Artificial Sequence: Synthetic oligonucleotide
accauggccagugagaguaaa

SEQ ID NO: 2302 - RNA, 21 nt, Artificial Sequence
  Description of Artificial Sequence: Synthetic oligonucleotide
ccagugagaguaaauuucuaa

SEQ ID NO: 2303 - RNA, 21 nt, Artificial Sequence
  Description of Artificial Sequence: Synthetic oligonucleotide
gaguaaauuucuauucaggaa

SEQ ID NO: 2304 - RNA, 21 nt, Artificial Sequence
  Description of Artificial Sequence: Synthetic oligonucleotide
uucuauucaggaagaauuaca

SEQ ID NO: 2305 - RNA, 21 nt, Artificial Sequence
  Description of Artificial Sequence: Synthetic oligonucleotide
caggaagaauuacgcaaaaua

SEQ ID NO: 2306 - RNA, 21 nt, Artificial Sequence
  Description of Artificial Sequence: Synthetic oligonucleotide
aauuacgcaaaauacgaguua

SEQ ID NO: 2307 - RNA, 21 nt, Artificial Sequence
  Description of Artificial Sequence: Synthetic oligonucleotide
caaaauacgaguucuuuaaaa

SEQ ID NO: 2308 - RNA, 21 nt, Artificial Sequence
  Description of Artificial Sequence: Synthetic oligonucleotide
uuucuucccagaacagaugga

SEQ ID NO: 2309 - RNA, 21 nt, Artificial Sequence
  Description of Artificial Sequence: Synthetic oligonucleotide
ccagaacagaugguuacuuga

SEQ ID NO: 2310 - RNA, 21 nt, Artificial Sequence
  Description of Artificial Sequence: Synthetic oligonucleotide
agaugguuacuuggugccaga

SEQ ID NO: 2311 - RNA, 21 nt, Artificial Sequence
  Description of Artificial Sequence: Synthetic oligonucleotide
uacuuggugccagcagucaaa

SEQ ID NO: 2312 - RNA, 21 nt, Artificial Sequence
  Description of Artificial Sequence: Synthetic oligonucleotide
ugccagcagucaaauggcaga

SEQ ID NO: 2313 - RNA, 21 nt, Artificial Sequence
  Description of Artificial Sequence: Synthetic oligonucleotide
agucaaauggcagucaaacca

SEQ ID NO: 2314 - RNA, 21 nt, Artificial Sequence
  Description of Artificial Sequence: Synthetic oligonucleotide
uggcagucaaacccagcuuua

SEQ ID NO: 2315 - RNA, 21 nt, Artificial Sequence
  Description of Artificial Sequence: Synthetic oligonucleotide
uuuucugaacuccaguaguua

SEQ ID NO: 2316 - RNA, 21 nt, Artificial Sequence
  Description of Artificial Sequence: Synthetic oligonucleotide
aacuccaguaguuguccugaa

SEQ ID NO: 2317 - RNA, 21 nt, Artificial Sequence
  Description of Artificial Sequence: Synthetic oligonucleotide
guaguuguccugaaauucaaa

SEQ ID NO: 2318 - RNA, 21 nt, Artificial Sequence
  Description of Artificial Sequence: Synthetic oligonucleotide
uugcaugugaaagagcuggga

SEQ ID NO: 2319 - RNA, 21 nt, Artificial Sequence
  Description of Artificial Sequence: Synthetic oligonucleotide
ugaaagagcugggaaagaaaa

SEQ ID NO: 2320 - RNA, 21 nt, Artificial Sequence
  Description of Artificial Sequence: Synthetic oligonucleotide
gcugggaaagaaaucauggaa

SEQ ID NO: 2321 - RNA, 21 nt, Artificial Sequence
  Description of Artificial Sequence: Synthetic oligonucleotide
aagcuguauguguguuugcga

SEQ ID NO: 2322 - RNA, 21 nt, Artificial Sequence
  Description of Artificial Sequence: Synthetic oligonucleotide
auguguguuugcggagaucua

SEQ ID NO: 2323 - RNA, 21 nt, Artificial Sequence
  Description of Artificial Sequence: Synthetic oligonucleotide
uuugcggagaucuggccuuua

SEQ ID NO: 2324 - RNA, 21 nt, Artificial Sequence
  Description of Artificial Sequence: Synthetic oligonucleotide
agaucuggccuuuauugcuca

SEQ ID NO: 2325 - RNA, 21 nt, Artificial Sequence
  Description of Artificial Sequence: Synthetic oligonucleotide
gccuuuauugcuccaccaaga

SEQ ID NO: 2326 - RNA, 21 nt, Artificial Sequence
  Description of Artificial Sequence: Synthetic oligonucleotide
uugcuccaccaagggaacuua

SEQ ID NO: 2327 - RNA, 21 nt, Artificial Sequence
  Description of Artificial Sequence: Synthetic oligonucleotide
gccgaccuggaggacagcaaa

SEQ ID NO: 2328 - RNA, 21 nt, Artificial Sequence
  Description of Artificial Sequence: Synthetic oligonucleotide
uggaggacagcaacaucuuca

SEQ ID NO: 2329 - RNA, 21 nt, Artificial Sequence
  Description of Artificial Sequence: Synthetic oligonucleotide
cagcaacaucuucucccugaa

SEQ ID NO: 2330 - RNA, 21 nt, Artificial Sequence
  Description of Artificial Sequence: Synthetic oligonucleotide
aucuucucccugaucgcugga

SEQ ID NO: 2331 - RNA, 21 nt, Artificial Sequence
  Description of Artificial Sequence: Synthetic oligonucleotide
cccugaucgcuggcaggaaga

SEQ ID NO: 2332 - RNA, 21 nt, Artificial Sequence
  Description of Artificial Sequence: Synthetic oligonucleotide
cgcuggcaggaagcaguacaa

SEQ ID NO: 2333 - RNA, 21 nt, Artificial Sequence
  Description of Artificial Sequence: Synthetic oligonucleotide
uacagaccacgggcucugcaa

SEQ ID NO: 2334 - RNA, 21 nt, Artificial Sequence
  Description of Artificial Sequence: Synthetic oligonucleotide
aaacaaagucaggaaugaaaa

SEQ ID NO: 2335 - RNA, 21 nt, Artificial Sequence
  Description of Artificial Sequence: Synthetic oligonucleotide
gucaggaaugaaacuaaagaa

SEQ ID NO: 2336 - RNA, 21 nt, Artificial Sequence
  Description of Artificial Sequence: Synthetic oligonucleotide
augaaacuaaagagcugagga

SEQ ID NO: 2337 - RNA, 21 nt, Artificial Sequence
  Description of Artificial Sequence: Synthetic oligonucleotide
uaaagagcugagguugcucua

SEQ ID NO: 2338 - RNA, 21 nt, Artificial Sequence
  Description of Artificial Sequence: Synthetic oligonucleotide
cugagguugcucugugcagaa

SEQ ID NO: 2339 - RNA, 21 nt, Artificial Sequence
  Description of Artificial Sequence: Synthetic oligonucleotide
ugcucugugcagaggacgaga

SEQ ID NO: 2340 - RNA, 21 nt, Artificial Sequence
  Description of Artificial Sequence: Synthetic oligonucleotide
ugcagaggacgagcaaaccaa

SEQ ID NO: 2341 - RNA, 21 nt, Artificial Sequence
  Description of Artificial Sequence: Synthetic oligonucleotide
gacgagcaaaccaggacguga

SEQ ID NO: 2342 - RNA, 21 nt, Artificial Sequence
  Description of Artificial Sequence: Synthetic oligonucleotide
aaaccaggacgugcuggauga

SEQ ID NO: 2343 - RNA, 21 nt, Artificial Sequence
  Description of Artificial Sequence: Synthetic oligonucleotide
gacgugcuggaugacagcgua

SEQ ID NO: 2344 - RNA, 21 nt, Artificial Sequence
  Description of Artificial Sequence: Synthetic oligonucleotide
uggaugacagcguucagacua

SEQ ID NO: 2345 - RNA, 21 nt, Artificial Sequence
  Description of Artificial Sequence: Synthetic oligonucleotide
uggaaugcuccuuuaccagaa

SEQ ID NO: 2346 - RNA, 21 nt, Artificial Sequence
  Description of Artificial Sequence: Synthetic oligonucleotide
cuccuuuaccagaauuaccga

SEQ ID NO: 2347 - RNA, 21 nt, Artificial Sequence
  Description of Artificial Sequence: Synthetic oligonucleotide
accagaauuaccgaaucccua

SEQ ID NO: 2348 - RNA, 21 nt, Artificial Sequence
  Description of Artificial Sequence: Synthetic oligonucleotide
uuaccgaaucccucagcagaa

SEQ ID NO: 2349 - RNA, 21 nt, Artificial Sequence
  Description of Artificial Sequence: Synthetic oligonucleotide
aucccucagcagaggaaggca

SEQ ID NO: 2350 - RNA, 21 nt, Artificial Sequence
  Description of Artificial Sequence: Synthetic oligonucleotide
agcagaggaaggccuugcuga

SEQ ID NO: 2351 - RNA, 21 nt, Artificial Sequence
  Description of Artificial Sequence: Synthetic oligonucleotide
cagugucuccgagaacuccca

SEQ ID NO: 2352 - RNA, 21 nt, Artificial Sequence
  Description of Artificial Sequence: Synthetic oligonucleotide
uccgagaacucccucguggca

SEQ ID NO: 2353 - RNA, 21 nt, Artificial Sequence
  Description of Artificial Sequence: Synthetic oligonucleotide
acucccucguggcaauggaua

SEQ ID NO: 2354 - RNA, 21 nt, Artificial Sequence
  Description of Artificial Sequence: Synthetic oligonucleotide
uucugggcaaacaggacgcga

SEQ ID NO: 2355 - RNA, 21 nt, Artificial Sequence
  Description of Artificial Sequence: Synthetic oligonucleotide
caaacaggacgcgugauagaa

SEQ ID NO: 2356 - RNA, 21 nt, Artificial Sequence
  Description of Artificial Sequence: Synthetic oligonucleotide
gacgcgugauagagaauccga

SEQ ID NO: 2357 - RNA, 21 nt, Artificial Sequence
  Description of Artificial Sequence: Synthetic oligonucleotide
gauagagaauccggcagagga

SEQ ID NO: 2358 - RNA, 21 nt, Artificial Sequence
  Description of Artificial Sequence: Synthetic oligonucleotide
aauccggcagaggcccagaga

SEQ ID NO: 2359 - RNA, 21 nt, Artificial Sequence
  Description of Artificial Sequence: Synthetic oligonucleotide
gcgaagcacacggaugaacaa

SEQ ID NO: 2360 - RNA, 21 nt, Artificial Sequence
  Description of Artificial Sequence: Synthetic oligonucleotide
acacggaugaacauccuagga

SEQ ID NO: 2361 - RNA, 21 nt, Artificial Sequence
  Description of Artificial Sequence: Synthetic oligonucleotide
ugaacauccuagguagccaaa

SEQ ID NO: 2362 - RNA, 21 nt, Artificial Sequence
  Description of Artificial Sequence: Synthetic oligonucleotide
cuccacccuucuacccuaaga

SEQ ID NO: 2363 - RNA, 21 nt, Artificial Sequence
  Description of Artificial Sequence: Synthetic oligonucleotide
auucacaggacacagcacuga

SEQ ID NO: 2364 - RNA, 21 nt, Artificial Sequence
  Description of Artificial Sequence: Synthetic oligonucleotide
ggacacagcacugguuucaca

SEQ ID NO: 2365 - RNA, 21 nt, Artificial Sequence
  Description of Artificial Sequence: Synthetic oligonucleotide
gcacugguuucacgggaggaa

SEQ ID NO: 2366 - RNA, 21 nt, Artificial Sequence
  Description of Artificial Sequence: Synthetic oligonucleotide
uuucacgggaggaucuccaga

SEQ ID NO: 2367 - RNA, 21 nt, Artificial Sequence
  Description of Artificial Sequence: Synthetic oligonucleotide
ggaggaucuccagggaggaaa

SEQ ID NO: 2368 - RNA, 21 nt, Artificial Sequence
  Description of Artificial Sequence: Synthetic oligonucleotide
cuccagggaggaaucccacaa

SEQ ID NO: 2369 - RNA, 21 nt, Artificial Sequence
  Description of Artificial Sequence: Synthetic oligonucleotide
gaggaaucccacaggaucaua

SEQ ID NO: 2370 - RNA, 21 nt, Artificial Sequence
  Description of Artificial Sequence: Synthetic oligonucleotide
cccacaggaucauuaaacaga

SEQ ID NO: 2371 - RNA, 21 nt, Artificial Sequence
  Description of Artificial Sequence: Synthetic oligonucleotide
gaucauuaaacagcaagggca

SEQ ID NO: 2372 - RNA, 21 nt, Artificial Sequence
  Description of Artificial Sequence: Synthetic oligonucleotide
aaacagcaagggcucguggaa

SEQ ID NO: 2373 - RNA, 23 nt, Artificial Sequence
  Description of Artificial Sequence: Synthetic oligonucleotide
ucuggucuuccuccugaaggcgc

SEQ ID NO: 2374 - RNA, 23 nt, Artificial Sequence
  Description of Artificial Sequence: Synthetic oligonucleotide
ugucccaucuucacuaaagacuu

SEQ ID NO: 2375 - RNA, 23 nt, Artificial Sequence
  Description of Artificial Sequence: Synthetic oligonucleotide
ucacagugacuuuuguaaaccag

SEQ ID NO: 2376 - RNA, 23 nt, Artificial Sequence
  Description of Artificial Sequence: Synthetic oligonucleotide
uucauccacacagugacuuuugu

SEQ ID NO: 2377 - RNA, 23 nt, Artificial Sequence
  Description of Artificial Sequence: Synthetic oligonucleotide
ugcuguugucauccacacaguga

SEQ ID NO: 2378 - RNA, 23 nt, Artificial Sequence
  Description of Artificial Sequence: Synthetic oligonucleotide
ugcagcugcaggugucuggguuc

SEQ ID NO: 2379 - RNA, 23 nt, Artificial Sequence
  Description of Artificial Sequence: Synthetic oligonucleotide
ugaggugucugcuccaccuuguc

SEQ ID NO: 2380 - RNA, 23 nt, Artificial Sequence
  Description of Artificial Sequence: Synthetic oligonucleotide
uugacugcgaggugucugcucca

SEQ ID NO: 2381 - RNA, 23 nt, Artificial Sequence
  Description of Artificial Sequence: Synthetic oligonucleotide
ugucuuguugacugcgagguguc

SEQ ID NO: 2382 - RNA, 23 nt, Artificial Sequence
  Description of Artificial Sequence: Synthetic oligonucleotide
ucugccgggucuuguugacugcg

SEQ ID NO: 2383 - RNA, 23 nt, Artificial Sequence
  Description of Artificial Sequence: Synthetic oligonucleotide
uccugguccugccgggucuuguu

SEQ ID NO: 2384 - RNA, 23 nt, Artificial Sequence
  Description of Artificial Sequence: Synthetic oligonucleotide
ucaagucggucagacugugcggg

SEQ ID NO: 2385 - RNA, 23 nt, Artificial Sequence
  Description of Artificial Sequence: Synthetic oligonucleotide
uugauucgcaagucggucagacu

SEQ ID NO: 2386 - RNA, 23 nt, Artificial Sequence
  Description of Artificial Sequence: Synthetic oligonucleotide
ugcuuccagguccacaucauccu

SEQ ID NO: 2387 - RNA, 23 nt, Artificial Sequence
  Description of Artificial Sequence: Synthetic oligonucleotide
ucaccagggcuuccagguccaca

SEQ ID NO: 2388 - RNA, 23 nt, Artificial Sequence
  Description of Artificial Sequence: Synthetic oligonucleotide
uuaucguucaccagggcuuccag

SEQ ID NO: 2389 - RNA, 23 nt, Artificial Sequence
  Description of Artificial Sequence: Synthetic oligonucleotide
ugcauucauaucguucaccaggg

SEQ ID NO: 2390 - RNA, 23 nt, Artificial Sequence
  Description of Artificial Sequence: Synthetic oligonucleotide
ucagggaugcauucauaucguuc

SEQ ID NO: 2391 - RNA, 23 nt, Artificial Sequence
  Description of Artificial Sequence: Synthetic oligonucleotide
uggcucuccagggaugcauucau

SEQ ID NO: 2392 - RNA, 23 nt, Artificial Sequence
  Description of Artificial Sequence: Synthetic oligonucleotide
ugaguacaggcucuccagggaug

SEQ ID NO: 2393 - RNA, 23 nt, Artificial Sequence
  Description of Artificial Sequence: Synthetic oligonucleotide
uugcaggccgaguacaggcucuc

SEQ ID NO: 2394 - RNA, 23 nt, Artificial Sequence
  Description of Artificial Sequence: Synthetic oligonucleotide
uugcaugcugcaggccgaguaca

SEQ ID NO: 2395 - RNA, 23 nt, Artificial Sequence
  Description of Artificial Sequence: Synthetic oligonucleotide
ugucugacugcaugcugcaggcc

SEQ ID NO: 2396 - RNA, 23 nt, Artificial Sequence
  Description of Artificial Sequence: Synthetic oligonucleotide
ugcaccgugucugacugcaugcu

SEQ ID NO: 2397 - RNA, 23 nt, Artificial Sequence
  Description of Artificial Sequence: Synthetic oligonucleotide
uugcuggccauucugcaggaggg

SEQ ID NO: 2398 - RNA, 23 nt, Artificial Sequence
  Description of Artificial Sequence: Synthetic oligonucleotide
uugcgggcaugcuggccauucug

SEQ ID NO: 2399 - RNA, 23 nt, Artificial Sequence
  Description of Artificial Sequence: Synthetic oligonucleotide
uauggaccgaggagggccugaag

SEQ ID NO: 2400 - RNA, 23 nt, Artificial Sequence
  Description of Artificial Sequence: Synthetic oligonucleotide
uuguggcuggauggaccgaggag

SEQ ID NO: 2401 - RNA, 23 nt, Artificial Sequence
  Description of Artificial Sequence: Synthetic oligonucleotide
uggacaccuguggcuggauggac

SEQ ID NO: 2402 - RNA, 23 nt, Artificial Sequence
  Description of Artificial Sequence: Synthetic oligonucleotide
uaugugcacaggcugggagcgcu

SEQ ID NO: 2403 - RNA, 23 nt, Artificial Sequence
  Description of Artificial Sequence: Synthetic oligonucleotide
uagcgaggaugugcacaggcugg

SEQ ID NO: 2404 - RNA, 23 nt, Artificial Sequence
  Description of Artificial Sequence: Synthetic oligonucleotide
uuaaacugcuggucuuccuccug

SEQ ID NO: 2405 - RNA, 23 nt, Artificial Sequence
  Description of Artificial Sequence: Synthetic oligonucleotide
ugagguucuaaacugcuggucuu

SEQ ID NO: 2406 - RNA, 23 nt, Artificial Sequence
  Description of Artificial Sequence: Synthetic oligonucleotide
ucagagaugagguucuaaacugc

SEQ ID NO: 2407 - RNA, 23 nt, Artificial Sequence
  Description of Artificial Sequence: Synthetic oligonucleotide
uuggccggcagagaugagguucu

SEQ ID NO: 2408 - RNA, 23 nt, Artificial Sequence
  Description of Artificial Sequence: Synthetic oligonucleotide
uagaguucaggaaaaggauuggg

SEQ ID NO: 2409 - RNA, 23 nt, Artificial Sequence
  Description of Artificial Sequence: Synthetic oligonucleotide
ugggccacagaguucaggaaaag

SEQ ID NO: 2410 - RNA, 23 nt, Artificial Sequence
  Description of Artificial Sequence: Synthetic oligonucleotide
ugcucccagggccacagaguuca

SEQ ID NO: 2411 - RNA, 23 nt, Artificial Sequence
  Description of Artificial Sequence: Synthetic oligonucleotide
uaagaacccggcgugagcacagg

SEQ ID NO: 2412 - RNA, 23 nt, Artificial Sequence
  Description of Artificial Sequence: Synthetic oligonucleotide
uggagguaaagaacccggcguga

SEQ ID NO: 2413 - RNA, 23 nt, Artificial Sequence
  Description of Artificial Sequence: Synthetic oligonucleotide
ucuggcucggagguaaagaaccc

SEQ ID NO: 2414 - RNA, 23 nt, Artificial Sequence
  Description of Artificial Sequence: Synthetic oligonucleotide
uagaaucuccaccacuuugcuug

SEQ ID NO: 2415 - RNA, 23 nt, Artificial Sequence
  Description of Artificial Sequence: Synthetic oligonucleotide
ucuucacuaaagacuuuaacauc

SEQ ID NO: 2416 - RNA, 23 nt, Artificial Sequence
  Description of Artificial Sequence: Synthetic oligonucleotide
uuuugcuugucccaucuucacua

SEQ ID NO: 2417 - RNA, 23 nt, Artificial Sequence
  Description of Artificial Sequence: Synthetic oligonucleotide
uccaccacuuugcuugucccauc

SEQ ID NO: 2418 - RNA, 23 nt, Artificial Sequence
  Description of Artificial Sequence: Synthetic oligonucleotide
ugucugcuagaaucuccaccacu

SEQ ID NO: 2419 - RNA, 23 nt, Artificial Sequence
  Description of Artificial Sequence: Synthetic oligonucleotide
ucugucaugucugcuagaaucuc

SEQ ID NO: 2420 - RNA, 23 nt, Artificial Sequence
  Description of Artificial Sequence: Synthetic oligonucleotide
uucucuggcugucaugucugcua

SEQ ID NO: 2421 - RNA, 23 nt, Artificial Sequence
  Description of Artificial Sequence: Synthetic oligonucleotide
ugcacaggucucuggcugucaug

SEQ ID NO: 2422 - RNA, 23 nt, Artificial Sequence
  Description of Artificial Sequence: Synthetic oligonucleotide
ugcaauuggcacaggucucuggc

SEQ ID NO: 2423 - RNA, 23 nt, Artificial Sequence
  Description of Artificial Sequence: Synthetic oligonucleotide
uuaaaccagcaauuggcacaggu

SEQ ID NO: 2424 - RNA, 23 nt, Artificial Sequence
  Description of Artificial Sequence: Synthetic oligonucleotide
uacuuuuguaaaccagcaauugg

SEQ ID NO: 2425 - RNA, 23 nt, Artificial Sequence
  Description of Artificial Sequence: Synthetic oligonucleotide
uguguccagcuguugucauccac

SEQ ID NO: 2426 - RNA, 23 nt, Artificial Sequence
  Description of Artificial Sequence: Synthetic oligonucleotide
uuccacuaguguccagcuguugu

SEQ ID NO: 2427 - RNA, 23 nt, Artificial Sequence
  Description of Artificial Sequence: Synthetic oligonucleotide
uguggugcuccacuaguguccag

SEQ ID NO: 2428 - RNA, 23 nt, Artificial Sequence
  Description of Artificial Sequence: Synthetic oligonucleotide
uaggugcggguggugcuccacua

SEQ ID NO: 2429 - RNA, 23 nt, Artificial Sequence
  Description of Artificial Sequence: Synthetic oligonucleotide
uuaauccuaggugcggguggugc

SEQ ID NO: 2430 - RNA, 23 nt, Artificial Sequence
  Description of Artificial Sequence: Synthetic oligonucleotide
uucauggucuuccaagcaccucu

SEQ ID NO: 2431 - RNA, 23 nt, Artificial Sequence
  Description of Artificial Sequence: Synthetic oligonucleotide
ucaccagcucauggucuuccaag

SEQ ID NO: 2432 - RNA, 23 nt, Artificial Sequence
  Description of Artificial Sequence: Synthetic oligonucleotide
uccuggaccaccagcucaugguc

SEQ ID NO: 2433 - RNA, 23 nt, Artificial Sequence
  Description of Artificial Sequence: Synthetic oligonucleotide
ucucuccaccuggaccaccagcu

SEQ ID NO: 2434 - RNA, 23 nt, Artificial Sequence
  Description of Artificial Sequence: Synthetic oligonucleotide
ucaugguacucuccaccuggacc

SEQ ID NO: 2435 - RNA, 23 nt, Artificial Sequence
  Description of Artificial Sequence: Synthetic oligonucleotide
ucacuggccaugguacucuccac

SEQ ID NO: 2436 - RNA, 23 nt, Artificial Sequence
  Description of Artificial Sequence: Synthetic oligonucleotide
uuuacucucacuggccaugguac

SEQ ID NO: 2437 - RNA, 23 nt, Artificial Sequence
  Description of Artificial Sequence: Synthetic oligonucleotide
uuagaaauuuacucucacuggcc

SEQ ID NO: 2438 - RNA, 23 nt, Artificial Sequence
  Description of Artificial Sequence: Synthetic oligonucleotide
uuccugaauagaaauuuacucuc

SEQ ID NO: 2439 - RNA, 23 nt, Artificial Sequence
  Description of Artificial Sequence: Synthetic oligonucleotide
uguaauucuuccugaauagaaau

SEQ ID NO: 2440 - RNA, 23 nt, Artificial Sequence
  Description of Artificial Sequence: Synthetic oligonucleotide
uauuuugcguaauucuuccugaa

SEQ ID NO: 2441 - RNA, 23 nt, Artificial Sequence
  Description of Artificial Sequence: Synthetic oligonucleotide
uaacucguauuuugcguaauucu

SEQ ID NO: 2442 - RNA, 23 nt, Artificial Sequence
  Description of Artificial Sequence: Synthetic oligonucleotide
uuuuaaagaacucguauuuugcg

SEQ ID NO: 2443 - RNA, 23 nt, Artificial Sequence
  Description of Artificial Sequence: Synthetic oligonucleotide
uccaucuguucugggaagaaauu

SEQ ID NO: 2444 - RNA, 23 nt, Artificial Sequence
  Description of Artificial Sequence: Synthetic oligonucleotide
ucaaguaaccaucuguucuggga

SEQ ID NO: 2445 - RNA, 23 nt, Artificial Sequence
  Description of Artificial Sequence: Synthetic oligonucleotide
ucuggcaccaaguaaccaucugu

SEQ ID NO: 2446 - RNA, 23 nt, Artificial Sequence
  Description of Artificial Sequence: Synthetic oligonucleotide
uuugacugcuggcaccaaguaac

SEQ ID NO: 2447 - RNA, 23 nt, Artificial Sequence
  Description of Artificial Sequence: Synthetic oligonucleotide
ucugccauuugacugcuggcacc

SEQ ID NO: 2448 - RNA, 23 nt, Artificial Sequence
  Description of Artificial Sequence: Synthetic oligonucleotide
ugguuugacugccauuugacugc

SEQ ID NO: 2449 - RNA, 23 nt, Artificial Sequence
  Description of Artificial Sequence: Synthetic oligonucleotide
uaaagcuggguuugacugccauu

SEQ ID NO: 2450 - RNA, 23 nt, Artificial Sequence
  Description of Artificial Sequence: Synthetic oligonucleotide
uaacuacuggaguucagaaaauu

SEQ ID NO: 2451 - RNA, 23 nt, Artificial Sequence
  Description of Artificial Sequence: Synthetic oligonucleotide
uucaggacaacuacuggaguuca

SEQ ID NO: 2452 - RNA, 23 nt, Artificial Sequence
  Description of Artificial Sequence: Synthetic oligonucleotide
uuugaauuucaggacaacuacug

SEQ ID NO: 2453 - RNA, 23 nt, Artificial Sequence
  Description of Artificial Sequence: Synthetic oligonucleotide
ucccagcucuuucacaugcaaaa

SEQ ID NO: 2454 - RNA, 23 nt, Artificial Sequence
  Description of Artificial Sequence: Synthetic oligonucleotide
uuuucuuucccagcucuuucaca

SEQ ID NO: 2455 - RNA, 23 nt, Artificial Sequence
  Description of Artificial Sequence: Synthetic oligonucleotide
uuccaugauuucuuucccagcuc

SEQ ID NO: 2456 - RNA, 23 nt, Artificial Sequence
  Description of Artificial Sequence: Synthetic oligonucleotide
ucgcaaacacacauacagcuuuu

SEQ ID NO: 2457 - RNA, 23 nt, Artificial Sequence
  Description of Artificial Sequence: Synthetic oligonucleotide
uagaucuccgcaaacacacauac

SEQ ID NO: 2458 - RNA, 23 nt, Artificial Sequence
  Description of Artificial Sequence: Synthetic oligonucleotide
uaaaggccagaucuccgcaaaca

SEQ ID NO: 2459 - RNA, 23 nt, Artificial Sequence
  Description of Artificial Sequence: Synthetic oligonucleotide
ugagcaauaaaggccagaucucc

SEQ ID NO: 2460 - RNA, 23 nt, Artificial Sequence
  Description of Artificial Sequence: Synthetic oligonucleotide
ucuugguggagcaauaaaggcca

SEQ ID NO: 2461 - RNA, 23 nt, Artificial Sequence
  Description of Artificial Sequence: Synthetic oligonucleotide
uaaguucccuugguggagcaaua

SEQ ID NO: 2462 - RNA, 23 nt, Artificial Sequence
  Description of Artificial Sequence: Synthetic oligonucleotide
uuugcuguccuccaggucggcca

SEQ ID NO: 2463 - RNA, 23 nt, Artificial Sequence
  Description of Artificial Sequence: Synthetic oligonucleotide
ugaagauguugcuguccuccagg

SEQ ID NO: 2464 - RNA, 23 nt, Artificial Sequence
  Description of Artificial Sequence: Synthetic oligonucleotide
uucagggagaagauguugcuguc

SEQ ID NO: 2465 - RNA, 23 nt, Artificial Sequence
  Description of Artificial Sequence: Synthetic oligonucleotide
uccagcgaucagggagaagaugu

SEQ ID NO: 2466 - RNA, 23 nt, Artificial Sequence
  Description of Artificial Sequence: Synthetic oligonucleotide
ucuuccugccagcgaucagggag

SEQ ID NO: 2467 - RNA, 23 nt, Artificial Sequence
  Description of Artificial Sequence: Synthetic oligonucleotide
uuguacugcuuccugccagcgau

SEQ ID NO: 2468 - RNA, 23 nt, Artificial Sequence
  Description of Artificial Sequence: Synthetic oligonucleotide
uugcagagcccguggucuguagg

SEQ ID NO: 2469 - RNA, 23 nt, Artificial Sequence
  Description of Artificial Sequence: Synthetic oligonucleotide
uuuucauuccugacuuuguuugg

SEQ ID NO: 2470 - RNA, 23 nt, Artificial Sequence
  Description of Artificial Sequence: Synthetic oligonucleotide
uucuuuaguuucauuccugacuu

SEQ ID NO: 2471 - RNA, 23 nt, Artificial Sequence
  Description of Artificial Sequence: Synthetic oligonucleotide
uccucagcucuuuaguuucauuc

SEQ ID NO: 2472 - RNA, 23 nt, Artificial Sequence
  Description of Artificial Sequence: Synthetic oligonucleotide
uagagcaaccucagcucuuuagu

SEQ ID NO: 2473 - RNA, 23 nt, Artificial Sequence
  Description of Artificial Sequence: Synthetic oligonucleotide
uucugcacagagcaaccucagcu

SEQ ID NO: 2474 - RNA, 23 nt, Artificial Sequence
  Description of Artificial Sequence: Synthetic oligonucleotide
ucucguccucugcacagagcaac

SEQ ID NO: 2475 - RNA, 23 nt, Artificial Sequence
  Description of Artificial Sequence: Synthetic oligonucleotide
uugguuugcucguccucugcaca

SEQ ID NO: 2476 - RNA, 23 nt, Artificial Sequence
  Description of Artificial Sequence: Synthetic oligonucleotide
ucacguccugguuugcucguccu

SEQ ID NO: 2477 - RNA, 23 nt, Artificial Sequence
  Description of Artificial Sequence: Synthetic oligonucleotide
ucauccagcacguccugguuugc

SEQ ID NO: 2478 - RNA, 23 nt, Artificial Sequence
  Description of Artificial Sequence: Synthetic oligonucleotide
uacgcugucauccagcacguccu

SEQ ID NO: 2479 - RNA, 23 nt, Artificial Sequence
  Description of Artificial Sequence: Synthetic oligonucleotide
uagucugaacgcugucauccagc

SEQ ID NO: 2480 - RNA, 23 nt, Artificial Sequence
  Description of Artificial Sequence: Synthetic oligonucleotide
uucugguaaaggagcauuccaua

SEQ ID NO: 2481 - RNA, 23 nt, Artificial Sequence
  Description of Artificial Sequence: Synthetic oligonucleotide
ucgguaauucugguaaaggagca

SEQ ID NO: 2482 - RNA, 23 nt, Artificial Sequence
  Description of Artificial Sequence: Synthetic oligonucleotide
uagggauucgguaauucugguaa

SEQ ID NO: 2483 - RNA, 23 nt, Artificial Sequence
  Description of Artificial Sequence: Synthetic oligonucleotide
uucugcugagggauucgguaauu

SEQ ID NO: 2484 - RNA, 23 nt, Artificial Sequence
  Description of Artificial Sequence: Synthetic oligonucleotide
ugccuuccucugcugagggauuc

SEQ ID NO: 2485 - RNA, 23 nt, Artificial Sequence
  Description of Artificial Sequence: Synthetic oligonucleotide
ucagcaaggccuuccucugcuga

SEQ ID NO: 2486 - RNA, 23 nt, Artificial Sequence
  Description of Artificial Sequence: Synthetic oligonucleotide
ugggaguucucggagacacugcg

SEQ ID NO: 2487 - RNA, 23 nt, Artificial Sequence
  Description of Artificial Sequence: Synthetic oligonucleotide
ugccacgagggaguucucggaga

SEQ ID NO: 2488 - RNA, 23 nt, Artificial Sequence
  Description of Artificial Sequence: Synthetic oligonucleotide
uauccauugccacgagggaguuc

SEQ ID NO: 2489 - RNA, 23 nt, Artificial Sequence
  Description of Artificial Sequence: Synthetic oligonucleotide
ucgcguccuguuugcccagaaaa

SEQ ID NO: 2490 - RNA, 23 nt, Artificial Sequence
  Description of Artificial Sequence: Synthetic oligonucleotide
uucuaucacgcguccuguuugcc

SEQ ID NO: 2491 - RNA, 23 nt, Artificial Sequence
  Description of Artificial Sequence: Synthetic oligonucleotide
ucggauucucuaucacgcguccu

SEQ ID NO: 2492 - RNA, 23 nt, Artificial Sequence
  Description of Artificial Sequence: Synthetic oligonucleotide
uccucugccggauucucuaucac

SEQ ID NO: 2493 - RNA, 23 nt, Artificial Sequence
  Description of Artificial Sequence: Synthetic oligonucleotide
ucucugggccucugccggauucu

SEQ ID NO: 2494 - RNA, 23 nt, Artificial Sequence
  Description of Artificial Sequence: Synthetic oligonucleotide
uuguucauccgugugcuucgcuu

SEQ ID NO: 2495 - RNA, 23 nt, Artificial Sequence
  Description of Artificial Sequence: Synthetic oligonucleotide
uccuaggauguucauccgugugc

SEQ ID NO: 2496 - RNA, 23 nt, Artificial Sequence
  Description of Artificial Sequence: Synthetic oligonucleotide
uuuggcuaccuaggauguucauc

SEQ ID NO: 2497 - RNA, 23 nt, Artificial Sequence
  Description of Artificial Sequence: Synthetic oligonucleotide
ucuuaggguagaaggguggaggg

SEQ ID NO: 2498 - RNA, 23 nt, Artificial Sequence
  Description of Artificial Sequence: Synthetic oligonucleotide
ucagugcuguguccugugaauca

SEQ ID NO: 2499 - RNA, 23 nt, Artificial Sequence
  Description of Artificial Sequence: Synthetic oligonucleotide
ugugaaaccagugcuguguccug

SEQ ID NO: 2500 - RNA, 23 nt, Artificial Sequence
  Description of Artificial Sequence: Synthetic oligonucleotide
uuccucccgugaaaccagugcug

SEQ ID NO: 2501 - RNA, 23 nt, Artificial Sequence
  Description of Artificial Sequence: Synthetic oligonucleotide
ucuggagauccucccgugaaacc

SEQ ID NO: 2502 - RNA, 23 nt, Artificial Sequence
  Description of Artificial Sequence: Synthetic oligonucleotide
uuuccucccuggagauccucccg

SEQ ID NO: 2503 - RNA, 23 nt, Artificial Sequence
  Description of Artificial Sequence: Synthetic oligonucleotide
uugugggauuccucccuggagau

SEQ ID NO: 2504 - RNA, 23 nt, Artificial Sequence
  Description of Artificial Sequence: Synthetic oligonucleotide
uaugauccugugggauuccuccc

SEQ ID NO: 2505 - RNA, 23 nt, Artificial Sequence
  Description of Artificial Sequence: Synthetic oligonucleotide
ucuguuuaaugauccugugggau

SEQ ID NO: 2506 - RNA, 23 nt, Artificial Sequence
  Description of Artificial Sequence: Synthetic oligonucleotide
ugcccuugcuguuuaaugauccu

SEQ ID NO: 2507 - RNA, 23 nt, Artificial Sequence
  Description of Artificial Sequence: Synthetic oligonucleotide
uuccacgagcccuugcuguuuaa

SEQ ID NO: 2508 - RNA, 23 nt, Homo sapiens
gcgccuucaggaggaagaccagc

SEQ ID NO: 2509 - RNA, 23 nt, Homo sapiens
aagucuuuagugaagaugggaca

SEQ ID NO: 2510 - RNA, 23 nt, Homo sapiens
cugguuuacaaaagucacugugu

SEQ ID NO: 2511 - RNA, 23 nt, Homo sapiens
acaaaagucacuguguggaugac

SEQ ID NO: 2512 - RNA, 23 nt, Homo sapiens
ucacuguguggaugacaacagcu

SEQ ID NO: 2513 - RNA, 23 nt, Homo sapiens
gaacccagacaccugcagcugcu

SEQ ID NO: 2514 - RNA, 23 nt, Homo sapiens
gacaagguggagcagacaccucg

SEQ ID NO: 2515 - RNA, 23 nt, Homo sapiens
uggagcagacaccucgcagucaa

SEQ ID NO: 2516 - RNA, 23 nt, Homo sapiens
gacaccucgcagucaacaagacc

SEQ ID NO: 2517 - RNA, 23 nt, Homo sapiens
cgcagucaacaagacccggcagg

SEQ ID NO: 2518 - RNA, 23 nt, Homo sapiens
aacaagacccggcaggaccagga

SEQ ID NO: 2519 - RNA, 23 nt, Homo sapiens
cccgcacagucugaccgacuugc

SEQ ID NO: 2520 - RNA, 23 nt, Homo sapiens
agucugaccgacuugcgaaucac

SEQ ID NO: 2521 - RNA, 23 nt, Homo sapiens
aggaugauguggaccuggaagcc

SEQ ID NO: 2522 - RNA, 23 nt, Homo sapiens
uguggaccuggaagcccugguga

SEQ ID NO: 2523 - RNA, 23 nt, Homo sapiens
cuggaagcccuggugaacgauau

SEQ ID NO: 2524 - RNA, 23 nt, Homo sapiens
cccuggugaacgauaugaaugca

SEQ ID NO: 2525 - RNA, 23 nt, Homo sapiens
gaacgauaugaaugcaucccugg

SEQ ID NO: 2526 - RNA, 23 nt, Homo sapiens
augaaugcaucccuggagagccu

SEQ ID NO: 2527 - RNA, 23 nt, Homo sapiens
caucccuggagagccuguacucg

SEQ ID NO: 2528 - RNA, 23 nt, Homo sapiens
gagagccuguacucggccugcag

SEQ ID NO: 2529 - RNA, 23 nt, Homo sapiens
uguacucggccugcagcaugcag

SEQ ID NO: 2530 - RNA, 23 nt, Homo sapiens
ggccugcagcaugcagucagaca

SEQ ID NO: 2531 - RNA, 23 nt, Homo sapiens
agcaugcagucagacacggugcc

SEQ ID NO: 2532 - RNA, 23 nt, Homo sapiens
cccuccugcagaauggccagcau

SEQ ID NO: 2533 - RNA, 23 nt, Homo sapiens
cagaauggccagcaugcccgcag

SEQ ID NO: 2534 - RNA, 23 nt, Homo sapiens
cuucaggcccuccucgguccauc

SEQ ID NO: 2535 - RNA, 23 nt, Homo sapiens
cuccucgguccauccagccacag

SEQ ID NO: 2536 - RNA, 23 nt, Homo sapiens
guccauccagccacagguguccc

SEQ ID NO: 2537 - RNA, 23 nt, Homo sapiens
agcgcucccagccugugcacauc

SEQ ID NO: 2538 - RNA, 23 nt, Homo sapiens
ccagccugugcacauccucgcug

SEQ ID NO: 2539 - RNA, 23 nt, Homo sapiens
caggaggaagaccagcaguuuag

SEQ ID NO: 2540 - RNA, 23 nt, Homo sapiens
aagaccagcaguuuagaaccuca

SEQ ID NO: 2541 - RNA, 23 nt, Homo sapiens
gcaguuuagaaccucaucucugc

SEQ ID NO: 2542 - RNA, 23 nt, Homo sapiens
agaaccucaucucugccggccau

SEQ ID NO: 2543 - RNA, 23 nt, Homo sapiens
cccaauccuuuuccugaacucug

SEQ ID NO: 2544 - RNA, 23 nt, Homo sapiens
cuuuuccugaacucuguggcccu

SEQ ID NO: 2545 - RNA, 23 nt, Homo sapiens
ugaacucuguggcccugggagcc

SEQ ID NO: 2546 - RNA, 23 nt, Homo sapiens
ccugugcucacgccggguucuuu

SEQ ID NO: 2547 - RNA, 23 nt, Homo sapiens
ucacgccggguucuuuaccuccg

SEQ ID NO: 2548 - RNA, 23 nt, Homo sapiens
ggguucuuuaccuccgagccagg

SEQ ID NO: 2549 - RNA, 23 nt, Homo sapiens
caagcaaagugguggagauucua

SEQ ID NO: 2550 - RNA, 23 nt, Homo sapiens
gauguuaaagucuuuagugaaga

SEQ ID NO: 2551 - RNA, 23 nt, Homo sapiens
uagugaagaugggacaagcaaag

SEQ ID NO: 2552 - RNA, 23 nt, Homo sapiens
gaugggacaagcaaaguggugga

SEQ ID NO: 2553 - RNA, 23 nt, Homo sapiens
agugguggagauucuagcagaca

SEQ ID NO: 2554 - RNA, 23 nt, Homo sapiens
gagauucuagcagacaugacagc

SEQ ID NO: 2555 - RNA, 23 nt, Homo sapiens
uagcagacaugacagccagagac

SEQ ID NO: 2556 - RNA, 23 nt, Homo sapiens
caugacagccagagaccugugcc

SEQ ID NO: 2557 - RNA, 23 nt, Homo sapiens
gccagagaccugugccaauugcu

SEQ ID NO: 2558 - RNA, 23 nt, Homo sapiens
accugugccaauugcugguuuac

SEQ ID NO: 2559 - RNA, 23 nt, Homo sapiens
ccaauugcugguuuacaaaaguc

SEQ ID NO: 2560 - RNA, 23 nt, Homo sapiens
guggaugacaacagcuggacacu

SEQ ID NO: 2561 - RNA, 23 nt, Homo sapiens
acaacagcuggacacuaguggag

SEQ ID NO: 2562 - RNA, 23 nt, Homo sapiens
cuggacacuaguggagcaccacc

SEQ ID NO: 2563 - RNA, 23 nt, Homo sapiens
uaguggagcaccacccgcaccua

SEQ ID NO: 2564 - RNA, 23 nt, Homo sapiens
gcaccacccgcaccuaggauuag

SEQ ID NO: 2565 - RNA, 23 nt, Homo sapiens
agaggugcuuggaagaccaugag

SEQ ID NO: 2566 - RNA, 23 nt, Homo sapiens
cuuggaagaccaugagcuggugg

SEQ ID NO: 2567 - RNA, 23 nt, Homo sapiens
gaccaugagcuggugguccaggu

SEQ ID NO: 2568 - RNA, 23 nt, Homo sapiens
agcuggugguccagguggagagu

SEQ ID NO: 2569 - RNA, 23 nt, Homo sapiens
gguccagguggagaguaccaugg

SEQ ID NO: 2570 - RNA, 23 nt, Homo sapiens
guggagaguaccauggccaguga

SEQ ID NO: 2571 - RNA, 23 nt, Homo sapiens
guaccauggccagugagaguaaa

SEQ ID NO: 2572 - RNA, 23 nt, Homo sapiens
ggccagugagaguaaauuucuau

SEQ ID NO: 2573 - RNA, 23 nt, Homo sapiens
gagaguaaauuucuauucaggaa

SEQ ID NO: 2574 - RNA, 23 nt, Homo sapiens
auuucuauucaggaagaauuacg

SEQ ID NO: 2575 - RNA, 23 nt, Homo sapiens
uucaggaagaauuacgcaaaaua

SEQ ID NO: 2576 - RNA, 23 nt, Homo sapiens
agaauuacgcaaaauacgaguuc

SEQ ID NO: 2577 - RNA, 23 nt, Homo sapiens
cgcaaaauacgaguucuuuaaaa

SEQ ID NO: 2578 - RNA, 23 nt, Homo sapiens
aauuucuucccagaacagauggu

SEQ ID NO: 2579 - RNA, 23 nt, Homo sapiens
ucccagaacagaugguuacuugg

SEQ ID NO: 2580 - RNA, 23 nt, Homo sapiens
acagaugguuacuuggugccagc

SEQ ID NO: 2581 - RNA, 23 nt, Homo sapiens
guuacuuggugccagcagucaaa

SEQ ID NO: 2582 - RNA, 23 nt, Homo sapiens
ggugccagcagucaaauggcagu

SEQ ID NO: 2583 - RNA, 23 nt, Homo sapiens
gcagucaaauggcagucaaaccc

SEQ ID NO: 2584 - RNA, 23 nt, Homo sapiens
aauggcagucaaacccagcuuuu

SEQ ID NO: 2585 - RNA, 23 nt, Homo sapiens
aauuuucugaacuccaguaguug

SEQ ID NO: 2586 - RNA, 23 nt, Homo sapiens
ugaacuccaguaguuguccugaa

SEQ ID NO: 2587 - RNA, 23 nt, Homo sapiens
caguaguuguccugaaauucaag

SEQ ID NO: 2588 - RNA, 23 nt, Homo sapiens
uuuugcaugugaaagagcuggga

SEQ ID NO: 2589 - RNA, 23 nt, Homo sapiens
ugugaaagagcugggaaagaaau

SEQ ID NO: 2590 - RNA, 23 nt, Homo sapiens
gagcugggaaagaaaucauggaa

SEQ ID NO: 2591 - RNA, 23 nt, Homo sapiens
aaaagcuguauguguguuugcgg

SEQ ID NO: 2592 - RNA, 23 nt, Homo sapiens
guauguguguuugcggagaucug

SEQ ID NO: 2593 - RNA, 23 nt, Homo sapiens
uguuugcggagaucuggccuuua

SEQ ID NO: 2594 - RNA, 23 nt, Homo sapiens
ggagaucuggccuuuauugcucc

SEQ ID NO: 2595 - RNA, 23 nt, Homo sapiens
uggccuuuauugcuccaccaagg

SEQ ID NO: 2596 - RNA, 23 nt, Homo sapiens
uauugcuccaccaagggaacuuc

SEQ ID NO: 2597 - RNA, 23 nt, Homo sapiens
uggccgaccuggaggacagcaac

SEQ ID NO: 2598 - RNA, 23 nt, Homo sapiens
ccuggaggacagcaacaucuucu

SEQ ID NO: 2599 - RNA, 23 nt, Homo sapiens
gacagcaacaucuucucccugau

SEQ ID NO: 2600 - RNA, 23 nt, Homo sapiens
acaucuucucccugaucgcuggc

SEQ ID NO: 2601 - RNA, 23 nt, Homo sapiens
cucccugaucgcuggcaggaagc

SEQ ID NO: 2602 - RNA, 23 nt, Homo sapiens
aucgcuggcaggaagcaguacaa

SEQ ID NO: 2603 - RNA, 23 nt, Homo sapiens
ccuacagaccacgggcucugcau

SEQ ID NO: 2604 - RNA, 23 nt, Homo sapiens
ccaaacaaagucaggaaugaaac

SEQ ID NO: 2605 - RNA, 23 nt, Homo sapiens
aagucaggaaugaaacuaaagag

SEQ ID NO: 2606 - RNA, 23 nt, Homo sapiens
gaaugaaacuaaagagcugaggu

SEQ ID NO: 2607 - RNA, 23 nt, Homo sapiens
acuaaagagcugagguugcucug

SEQ ID NO: 2608 - RNA, 23 nt, Homo sapiens
agcugagguugcucugugcagag

SEQ ID NO: 2609 - RNA, 23 nt, Homo sapiens
guugcucugugcagaggacgagc

SEQ ID NO: 2610 - RNA, 23 nt, Homo sapiens
ugugcagaggacgagcaaaccag

SEQ ID NO: 2611 - RNA, 23 nt, Homo sapiens
aggacgagcaaaccaggacgugc

SEQ ID NO: 2612 - RNA, 23 nt, Homo sapiens
gcaaaccaggacgugcuggauga

SEQ ID NO: 2613 - RNA, 23 nt, Homo sapiens
aggacgugcuggaugacagcguu

SEQ ID NO: 2614 - RNA, 23 nt, Homo sapiens
gcuggaugacagcguucagacuc

SEQ ID NO: 2615 - RNA, 23 nt, Homo sapiens
uauggaaugcuccuuuaccagaa

SEQ ID NO: 2616 - RNA, 23 nt, Homo sapiens
ugcuccuuuaccagaauuaccga

SEQ ID NO: 2617 - RNA, 23 nt, Homo sapiens
uuaccagaauuaccgaaucccuc

SEQ ID NO: 2618 - RNA, 23 nt, Homo sapiens
aauuaccgaaucccucagcagag

SEQ ID NO: 2619 - RNA, 23 nt, Homo sapiens
gaaucccucagcagaggaaggcc

SEQ ID NO: 2620 - RNA, 23 nt, Homo sapiens
ucagcagaggaaggccuugcugu

SEQ ID NO: 2621 - RNA, 23 nt, Homo sapiens
cgcagugucuccgagaacucccu

SEQ ID NO: 2622 - RNA, 23 nt, Homo sapiens
ucuccgagaacucccucguggca

SEQ ID NO: 2623 - RNA, 23 nt, Homo sapiens
gaacucccucguggcaauggauu

SEQ ID NO: 2624 - RNA, 23 nt, Homo sapiens
uuuucugggcaaacaggacgcgu

SEQ ID NO: 2625 - RNA, 23 nt, Homo sapiens
ggcaaacaggacgcgugauagag

SEQ ID NO: 2626 - RNA, 23 nt, Homo sapiens
aggacgcgugauagagaauccgg

SEQ ID NO: 2627 - RNA, 23 nt, Homo sapiens
gugauagagaauccggcagaggc

SEQ ID NO: 2628 - RNA, 23 nt, Homo sapiens
agaauccggcagaggcccagagc

SEQ ID NO: 2629 - RNA, 23 nt, Homo sapiens
aagcgaagcacacggaugaacau

SEQ ID NO: 2630 - RNA, 23 nt, Homo sapiens
gcacacggaugaacauccuaggu

SEQ ID NO: 2631 - RNA, 23 nt, Homo sapiens
gaugaacauccuagguagccaaa

SEQ ID NO: 2632 - RNA, 23 nt, Homo sapiens
cccuccacccuucuacccuaagu

SEQ ID NO: 2633 - RNA, 23 nt, Homo sapiens
ugauucacaggacacagcacugg

SEQ ID NO: 2634 - RNA, 23 nt, Homo sapiens
caggacacagcacugguuucacg

SEQ ID NO: 2635 - RNA, 23 nt, Homo sapiens
cagcacugguuucacgggaggau

SEQ ID NO: 2636 - RNA, 23 nt, Homo sapiens
gguuucacgggaggaucuccagg

SEQ ID NO: 2637 - RNA, 23 nt, Homo sapiens
cgggaggaucuccagggaggaau

SEQ ID NO: 2638 - RNA, 23 nt, Homo sapiens
aucuccagggaggaaucccacag

SEQ ID NO: 2639 - RNA, 23 nt, Homo sapiens
gggaggaaucccacaggaucauu

SEQ ID NO: 2640 - RNA, 23 nt, Homo sapiens
aucccacaggaucauuaaacagc

SEQ ID NO: 2641 - RNA, 23 nt, Homo sapiens
aggaucauuaaacagcaagggcu

SEQ ID NO: 2642 - RNA, 23 nt, Homo sapiens
uuaaacagcaagggcucguggau

SEQ ID NO: 2643 - RNA, 21 nt, Artificial Sequence
  Description of Artificial Sequence: Synthetic oligonucleotide
ugaagugcuauccaacugggu

SEQ ID NO: 2644 - RNA, 21 nt, Artificial Sequence
  Description of Artificial Sequence: Synthetic oligonucleotide
cugggggauagaagaagaaau

SEQ ID NO: 2645 - RNA, 21 nt, Artificial Sequence
  Description of Artificial Sequence: Synthetic oligonucleotide
ggggauagaagaagaaaacau

SEQ ID NO: 2646 - RNA, 21 nt, Artificial Sequence
  Description of Artificial Sequence: Synthetic oligonucleotide
gaaaaaauuaugccaaauauu

SEQ ID NO: 2647 - RNA, 21 nt, Artificial Sequence
  Description of Artificial Sequence: Synthetic oligonucleotide
aaaauuaugccaaauaugagu

SEQ ID NO: 2648 - RNA, 21 nt, Artificial Sequence
  Description of Artificial Sequence: Synthetic oligonucleotide
ccaaauaugaguucuuuaaau

SEQ ID NO: 2649 - RNA, 21 nt, Artificial Sequence
  Description of Artificial Sequence: Synthetic oligonucleotide
aaaaacccaauguauuuuuuu

SEQ ID NO: 2650 - RNA, 21 nt, Artificial Sequence
  Description of Artificial Sequence: Synthetic oligonucleotide
ccaauguauuuuuuuccagau

SEQ ID NO: 2651 - RNA, 21 nt, Artificial Sequence
  Description of Artificial Sequence: Synthetic oligonucleotide
auguauuuuuuuccagagcau

SEQ ID NO: 2652 - RNA, 21 nt, Artificial Sequence
  Description of Artificial Sequence: Synthetic oligonucleotide
aaaaaaaacauggagcaccgu

SEQ ID NO: 2653 - RNA, 21 nt, Artificial Sequence
  Description of Artificial Sequence: Synthetic oligonucleotide
aaaaacauggagcaccgacuu

SEQ ID NO: 2654 - RNA, 21 nt, Artificial Sequence
  Description of Artificial Sequence: Synthetic oligonucleotide
uaaccccaaaacuuucguacu

SEQ ID NO: 2655 - RNA, 21 nt, Artificial Sequence
  Description of Artificial Sequence: Synthetic oligonucleotide
ccccaaaacuuucguacuguu

SEQ ID NO: 2656 - RNA, 21 nt, Artificial Sequence
  Description of Artificial Sequence: Synthetic oligonucleotide
caaugagucauggacaaaaau

SEQ ID NO: 2657 - RNA, 23 nt, Artificial Sequence
  Description of Artificial Sequence: Synthetic oligonucleotide
acccaguuggauagcacuucaau

SEQ ID NO: 2658 - RNA, 23 nt, Artificial Sequence
  Description of Artificial Sequence: Synthetic oligonucleotide
auuucuucuucuaucccccaguu

SEQ ID NO: 2659 - RNA, 23 nt, Artificial Sequence
  Description of Artificial Sequence: Synthetic oligonucleotide
auguuuucuucuucuauccccca

SEQ ID NO: 2660 - RNA, 23 nt, Artificial Sequence
  Description of Artificial Sequence: Synthetic oligonucleotide
aauauuuggcauaauuuuuucua

SEQ ID NO: 2661 - RNA, 23 nt, Artificial Sequence
  Description of Artificial Sequence: Synthetic oligonucleotide
acucauauuuggcauaauuuuuu

SEQ ID NO: 2662 - RNA, 23 nt, Artificial Sequence
  Description of Artificial Sequence: Synthetic oligonucleotide
auuuaaagaacucauauuuggca

SEQ ID NO: 2663 - RNA, 23 nt, Artificial Sequence
  Description of Artificial Sequence: Synthetic oligonucleotide
aaaaaaauacauuggguuuuuaa

SEQ ID NO: 2664 - RNA, 23 nt, Artificial Sequence
  Description of Artificial Sequence: Synthetic oligonucleotide
aucuggaaaaaaauacauugggu

SEQ ID NO: 2665 - RNA, 23 nt, Artificial Sequence
  Description of Artificial Sequence: Synthetic oligonucleotide
augcucuggaaaaaaauacauug

SEQ ID NO: 2666 - RNA, 23 nt, Artificial Sequence
  Description of Artificial Sequence: Synthetic oligonucleotide
acggugcuccauguuuuuuuuug

SEQ ID NO: 2667 - RNA, 23 nt, Artificial Sequence
  Description of Artificial Sequence: Synthetic oligonucleotide
aagucggugcuccauguuuuuuu

SEQ ID NO: 2668 - RNA, 23 nt, Artificial Sequence
  Description of Artificial Sequence: Synthetic oligonucleotide
aguacgaaaguuuugggguuacu

SEQ ID NO: 2669 - RNA, 23 nt, Artificial Sequence
  Description of Artificial Sequence: Synthetic oligonucleotide
aacaguacgaaaguuuugggguu

SEQ ID NO: 2670 - RNA, 23 nt, Artificial Sequence
  Description of Artificial Sequence: Synthetic oligonucleotide
auuuuuguccaugacucauugac

SEQ ID NO: 2671 - RNA, 21 nt, Artificial Sequence
  Description of Artificial Sequence: Synthetic oligonucleotide
ugaagugcuauccaacugggu

SEQ ID NO: 2672 - RNA, 21 nt, Artificial Sequence
  Description of Artificial Sequence: Synthetic oligonucleotide
cugggggauagaagaagaaau

SEQ ID NO: 2673 - RNA, 21 nt, Artificial Sequence
  Description of Artificial Sequence: Synthetic oligonucleotide
ggggauagaagaagaaaacau

SEQ ID NO: 2674 - RNA, 21 nt, Artificial Sequence
  Description of Artificial Sequence: Synthetic oligonucleotide
gaaaaaauuaugccaaauauu

SEQ ID NO: 2675 - RNA, 21 nt, Artificial Sequence
  Description of Artificial Sequence: Synthetic oligonucleotide
aaaauuaugccaaauaugagu

SEQ ID NO: 2676 - RNA, 21 nt, Artificial Sequence
  Description of Artificial Sequence: Synthetic oligonucleotide
ccaaauaugaguucuuuaaau

SEQ ID NO: 2677 - RNA, 21 nt, Artificial Sequence
  Description of Artificial Sequence: Synthetic oligonucleotide
aaaaacccaauguauuuuuuu

SEQ ID NO: 2678 - RNA, 21 nt, Artificial Sequence
  Description of Artificial Sequence: Synthetic oligonucleotide
ccaauguauuuuuuuccagau

SEQ ID NO: 2679 - RNA, 21 nt, Artificial Sequence
  Description of Artificial Sequence: Synthetic oligonucleotide
auguauuuuuuuccagagcau

SEQ ID NO: 2680 - RNA, 21 nt, Artificial Sequence
  Description of Artificial Sequence: Synthetic oligonucleotide
aaaaaaaacauggagcaccgu

SEQ ID NO: 2681 - RNA, 21 nt, Artificial Sequence
  Description of Artificial Sequence: Synthetic oligonucleotide
aaaaacauggagcaccgacuu

SEQ ID NO: 2682 - RNA, 21 nt, Artificial Sequence
  Description of Artificial Sequence: Synthetic oligonucleotide
uaaccccaaaacuuucguacu

SEQ ID NO: 2683 - RNA, 21 nt, Artificial Sequence
  Description of Artificial Sequence: Synthetic oligonucleotide
ccccaaaacuuucguacuguu

SEQ ID NO: 2684 - RNA, 21 nt, Artificial Sequence
  Description of Artificial Sequence: Synthetic oligonucleotide
caaugagucauggacaaaaau

SEQ ID NO: 2685 - RNA, 23 nt, Artificial Sequence
  Description of Artificial Sequence: Synthetic oligonucleotide
acccaguuggauagcacuucaau

SEQ ID NO: 2686 - RNA, 23 nt, Artificial Sequence
  Description of Artificial Sequence: Synthetic oligonucleotide
auuucuucuucuaucccccaguu

SEQ ID NO: 2687 - RNA, 23 nt, Artificial Sequence
  Description of Artificial Sequence: Synthetic oligonucleotide
auguuuucuucuucuauccccca

SEQ ID NO: 2688 - RNA, 23 nt, Artificial Sequence
  Description of Artificial Sequence: Synthetic oligonucleotide
aauauuuggcauaauuuuuucua

SEQ ID NO: 2689 - RNA, 23 nt, Artificial Sequence
  Description of Artificial Sequence: Synthetic oligonucleotide
acucauauuuggcauaauuuuuu

SEQ ID NO: 2690 - RNA, 23 nt, Artificial Sequence
  Description of Artificial Sequence: Synthetic oligonucleotide
auuuaaagaacucauauuuggca

SEQ ID NO: 2691 - RNA, 23 nt, Artificial Sequence
  Description of Artificial Sequence: Synthetic oligonucleotide
aaaaaaauacauuggguuuuuaa

SEQ ID NO: 2692 - RNA, 23 nt, Artificial Sequence
  Description of Artificial Sequence: Synthetic oligonucleotide
aucuggaaaaaaauacauugggu

SEQ ID NO: 2693 - RNA, 23 nt, Artificial Sequence
  Description of Artificial Sequence: Synthetic oligonucleotide
augcucuggaaaaaaauacauug

SEQ ID NO: 2694 - RNA, 23 nt, Artificial Sequence
  Description of Artificial Sequence: Synthetic oligonucleotide
acggugcuccauguuuuuuuuug

SEQ ID NO: 2695 - RNA, 23 nt, Artificial Sequence
  Description of Artificial Sequence: Synthetic oligonucleotide
aagucggugcuccauguuuuuuu

SEQ ID NO: 2696 - RNA, 23 nt, Artificial Sequence
  Description of Artificial Sequence: Synthetic oligonucleotide
aguacgaaaguuuugggguuacu

SEQ ID NO: 2697 - RNA, 23 nt, Artificial Sequence
  Description of Artificial Sequence: Synthetic oligonucleotide
aacaguacgaaaguuuugggguu

SEQ ID NO: 2698 - RNA, 23 nt, Artificial Sequence
  Description of Artificial Sequence: Synthetic oligonucleotide
auuuuuguccaugacucauugac

SEQ ID NO: 2699 - RNA, 23 nt, Homo sapiens
auugaagugcuauccaacugggg

SEQ ID NO: 2700 - RNA, 23 nt, Homo sapiens
aacugggggauagaagaagaaaa

SEQ ID NO: 2701 - RNA, 23 nt, Homo sapiens
ugggggauagaagaagaaaacaa

SEQ ID NO: 2702 - RNA, 23 nt, Homo sapiens
uagaaaaaauuaugccaaauaug

SEQ ID NO: 2703 - RNA, 23 nt, Homo sapiens
aaaaaauuaugccaaauaugagu

SEQ ID NO: 2704 - RNA, 23 nt, Homo sapiens
ugccaaauaugaguucuuuaaaa

SEQ ID NO: 2705 - RNA, 23 nt, Homo sapiens
uuaaaaacccaauguauuuuuuu

SEQ ID NO: 2706 - RNA, 23 nt, Homo sapiens
acccaauguauuuuuuuccagag

SEQ ID NO: 2707 - RNA, 23 nt, Homo sapiens
caauguauuuuuuuccagagcau

SEQ ID NO: 2708 - RNA, 23 nt, Homo sapiens
caaaaaaaaacauggagcaccga

SEQ ID NO: 2709 - RNA, 23 nt, Homo sapiens
aaaaaaacauggagcaccgacua

SEQ ID NO: 2710 - RNA, 23 nt, Homo sapiens
aguaaccccaaaacuuucguacu

SEQ ID NO: 2711 - RNA, 23 nt, Homo sapiens
aaccccaaaacuuucguacuguc

SEQ ID NO: 2712 - RNA, 23 nt, Homo sapiens
gucaaugagucauggacaaaaaa

We claim:

1. A double stranded ribonucleic acid (dsRNA) agent for inhibiting expression of growth factor receptor bound protein 14 (GRB14) in a cell, wherein said dsRNA agent comprises a sense strand and an antisense strand forming a double stranded region, wherein said antisense strand comprises the antisense strand sequence set forth as SEQ ID NO: 905; wherein said sense strand comprises the sense strand sequence set forth as SEQ ID NO: 770; and wherein each of the sense strand and antisense strand is no more than 30 nucleotides in length.

2. The dsRNA agent of claim 1, wherein said dsRNA agent comprises at least one modified nucleotide.

3. The dsRNA agent of claim 1, wherein the dsRNA agent comprises a ligand, and wherein the ligand is an N-acetylgalactosamine (GalNAc) derivative.

4. The dsRNA agent of claim 3, wherein:

(a) the ligand is conjugated to the 3' end of the sense strand of the dsRNA agent;

(b) the ligand is

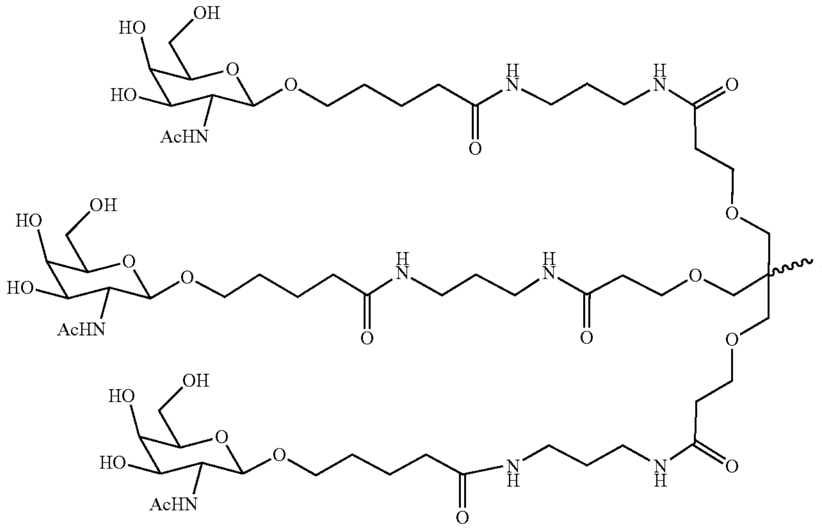
;

and/or (c) the dsRNA agent is conjugated to the ligand as shown in the following schematic

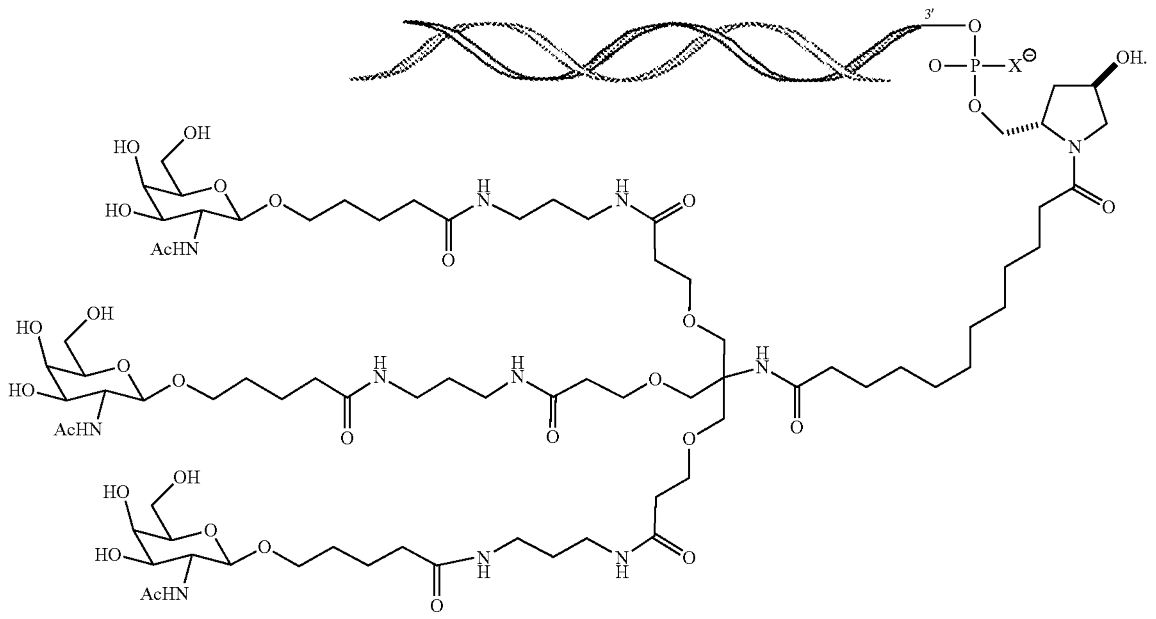

wherein X is O or S.

5. An isolated cell containing the dsRNA agent of claim 1.

6. A vector encoding the dsRNA agent of claim 1.

7. A pharmaceutical composition for inhibiting expression of GRB14, comprising the dsRNA agent of claim 1.

8. The dsRNA agent of claim 1, wherein the sense strand, the antisense strand, or both the sense strand and the antisense strand is conjugated to one or more lipophilic moieties, and wherein the one or more lipophilic moieties contain a saturated or unsaturated C16 hydrocarbon chain.

9. The dsRNA agent of claim 8, wherein the one or more lipophilic moieties are is conjugated to one or more internal positions in the double stranded region of the dsRNA agent.

10. The dsRNA agent of claim 9, wherein;

(a) the one or more internal positions include all positions except the terminal two positions from each end of the at least one strand;

(b) the one or more internal positions include all positions except the terminal three positions from each end of the at least one strand;

(c) the one or more internal positions exclude a cleavage site region of the sense strand;

(d) the one or more internal positions include all positions except positions 9-12, counting from the 5'-end of the sense strand;

(e) the one or more internal positions include all positions except positions 11-13, counting from the 3'-end of the sense strand;

(f) the one or more internal positions exclude a cleavage site region of the antisense strand;

(g) the one or more internal positions include all positions except positions 12-14, counting from the 5'-end of the antisense strand;

(h) the one or more internal positions include all positions except positions 11-13 on the sense strand, counting from the 3'-end, and positions 12-14 on the antisense strand, counting from the 5'-end;

(i) the one or more lipophilic moieties are conjugated to the one or more internal positions selected from the group consisting of positions 4-8 and 13-18 on the sense strand, and positions 6-10 and 15-18 on the antisense strand, counting from the 5'end of each strand;

(j) the one or more lipophilic moieties are conjugated to the one or more internal positions selected from the group consisting of positions 5, 6, 7, 15, and 17 on the sense strand, and positions 15 and 17 on the antisense strand, counting from the 5'-end of each strand;

(k) the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand; and/or (1) the one or more lipophilic moieties are conjugated to position 21, position 20, position 15, position 1, or position 7 of the sense strand.

11. The dsRNA agent of claim 1, wherein:

(a) not more than 5, 4, 3, 2, or 1 of the nucleotides of the sense strand are unmodified nucleotides;

(b) not more than 5, 4, 3, 2, or 1 of the nucleotides of the antisense strand are unmodified nucleotides;

(c) not more than 5, 4, 3, 2, or 1 of the nucleotides of the sense strand and not more than 5, 4, 3, 2, or 1 of the nucleotides of the antisense strand are unmodified nucleotides;

(d) all of the nucleotides of the sense strand comprise a modification selected from the group consisting of a 2'-O-methyl modification and a 2'-fluoro modification;

(e) all of the nucleotides of the sense strand comprise a modification;

(f) all of the nucleotides of the antisense strand comprise a modification;

(g) all of the nucleotides of the sense strand and all of the nucleotides of the antisense strand comprise a modification; and/or (h) said dsRNA agent comprises at least one modified nucleotide, wherein at least one of said modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O—(N-methylacetamide) modified nucleotide, and combinations thereof.

12. The dsRNA agent of claim 1, wherein:

(a) the sense strand comprises two phosphorothioate internucleotide linkages at the 5'-terminus;

(b) the antisense strand comprises two phosphorothioate internucleotide linkages at the 5'-terminus and two phosphorothioate internucleotide linkages at the 3'-terminus;

(c) each of the sense strand and antisense strands is independently 21-23 nucleotides in length;

(d) at least one of the sense strand or antisense strand comprises a 3' overhang of at least 1 nucleotide; and/or (e) at least one of the sense strand or antisense strand comprises a 3' overhang of at least 2 nucleotides.

13. The dsRNA agent of claim 1, wherein the antisense strand consists of the nucleotide sequence set forth as SEQ ID NO: 905.

14. The dsRNA agent of claim 13, wherein the sense strand consists of the nucleotide sequence set forth as SEQ ID NO: 770.

15. The dsRNA agent of claim 1, wherein the sense strand comprises the modified nucleotide sequence of 5'-asasauucAfuGfGfUfuucuuacauuL96-3' (SEQ ID NO: 1040), and the antisense strand comprises the modified nucleotide sequence of 5'-asAfsuguAfaGfAfaaccAfuGfaauuuscsa (SEQ ID NO: 1175), wherein a, g, c and u are 2'-O-methyl (2'-OMe) A, G, C, and U; s is a phosphorothioate linkage; Af, Gf, and Uf are 2'-fluoro A, G, and U; and L96 is N-[tris (GalNAc-alkyl)-amidodecanoyl)]-4-hydroxyprolinol.

16. The dsRNA agent of claim 1, wherein the sense strand consists of the modified nucleotide sequence of 5'-asasauucAfuGfGfUfuucuuacauuL96-3' (SEQ ID NO: 1040), and the antisense strand consists of the modified nucleotide sequence of 5'-asAfsuguAfaGfAfaaccAfuGfaauuuscsa-3' (SEQ ID NO: 1175), wherein a, g, c and u are 2'-O-methyl (2'-OMe) A, G, C, and U; s is a phosphorothioate linkage; Af, Gf, and Uf are 2'-fluoro A, G, and U; and L96 is N-[tris (GalNAc-alkyl)-amidodecanoyl)]-4-hydroxyprolinol.

17. A method of inhibiting growth factor receptor bound protein 14 (GRB14) expression in a cell, the method comprising introducing into the cell the dsRNA agent of claim 1, thereby inhibiting expression of GRB14 in the cell.

18. The method of claim 17, wherein:

(a) said cell is within a subject;

(b) the cell is within a subject, wherein the subject is a human;

(c) the GRB14 expression is inhibited by at least 30%, 40%, 50%, 60%, or 70%;

(d) the cell is within a subject having a GRB14-associated disease, disorder, or condition, wherein the GRB14-associated disease, disorder, or condition is diabetes, type 2 diabetes, type 1 diabetes, prediabetes, insulin resistance, obesity, diabetic neuropathy, diabetic nephropathy, diabetic vasculopathy, and diabetic retinopathy;

(e) the cell is within a subject and the subject is obese;

(f) the cell is within a subject and the method further comprises administering an additional therapeutic to the subject;

(g) the cell is within a subject, wherein the dsRNA agent is administered to the subject at a dose of 0.01 mg/kg to 50 mg/kg;

(h) the cell is within a subject and the method further comprises administering an additional therapeutic to the subject, wherein the dsRNA agent is administered to the subject intravenously, intramuscularly, or subcutaneously; and/or (i) the method further comprises determining the level of GRB14 in the subject.

* * * * *